United States Patent
Bennett et al.

(10) Patent No.: US 10,526,604 B2
(45) Date of Patent: Jan. 7, 2020

(54) MODULATION OF NUCLEAR-RETAINED RNA

(71) Applicant: Ionis Pharmaceuticals, Inc., Carlsbad, CA (US)

(72) Inventors: C. Frank Bennett, Carlsbad, CA (US); Huynh-Hoa Bui, San Diego, CA (US); Kenneth W. Dobie, Solana Beach, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 15/642,709

(22) Filed: Jul. 6, 2017

(65) Prior Publication Data

US 2018/0127758 A1    May 10, 2018

Related U.S. Application Data

(63) Continuation of application No. 13/810,879, filed as application No. PCT/US2011/044583 on Jul. 19, 2011, now abandoned.

(60) Provisional application No. 61/478,021, filed on Apr. 21, 2011, provisional application No. 61/365,775, filed on Jul. 19, 2010, provisional application No. 61/365,762, filed on Jul. 19, 2010.

(51) Int. Cl.
*C12N 15/11*    (2006.01)
*C12N 15/113*    (2010.01)

(52) U.S. Cl.
CPC ........ *C12N 15/1137* (2013.01); *C12N 15/113* (2013.01); *C12Y 207/11* (2013.01); *C12N 2310/11* (2013.01); *C12N 2310/315* (2013.01); *C12N 2310/3181* (2013.01); *C12N 2310/321* (2013.01); *C12N 2310/3231* (2013.01); *C12N 2310/3341* (2013.01); *C12N 2310/341* (2013.01); *C12N 2310/346* (2013.01); *C12N 2310/3525* (2013.01)

(58) Field of Classification Search
None
See application file for complete search history.

(56) References Cited

U.S. PATENT DOCUMENTS

| | | | |
|---|---|---|---|
| 5,552,282 A | 9/1996 | Caskey et al. | |
| 9,592,250 B2 | 3/2017 | Woolf et al. | |
| 2004/0147023 A1 | 7/2004 | Crooke et al. | |
| 2004/0241651 A1 | 12/2004 | Olek et al. | |
| 2007/0031940 A1 | 2/2007 | Van Rompaey et al. | |
| 2008/0242629 A1* | 10/2008 | Crooke ................ | C12N 15/113 514/44 A |

FOREIGN PATENT DOCUMENTS

| | | | |
|---|---|---|---|
| WO | WO 2001/019161 | 3/2001 | |
| WO | WO-02090514 A2 * | 11/2002 | ........... A61K 31/337 |

OTHER PUBLICATIONS

Ballantyne et al., "Locked nucleic acids in PCR primers increase sensitivity and performance" Genomics (2008) 91: 301-305.
Lebedev at el., "Oligonucleotides containing 2-aminoadenine and 5-methylcytosine are more effective as primers for PCR amplification than their nonmodified counterparts," Genetic Analysis: Biomolecular Engineering (1996) 13:15-21.
Noronha et al., "Amplimers with 1-15 3'-terminal phosphorothioate linkages resist degradation by Vent polymersase and reduce Taq polymerase mispriming," PCR Methods & Applicatio, Cold Spring Harbor Laboratory Press (1992) 2: 131-136.
European Search Report for application EP 14834532.5 dated Feb. 20, 2017.
Cho et al., "Myotonic dystrophy: Emerging mechanisms for DM1 and DM2" Biochemica et Biophysica Acta (2007) 1772: 195-204.
Partial Search Report for application EP 18199910.3 dated Apr. 11, 2019.

* cited by examiner

*Primary Examiner* — Ekaterina Poliakova-Georgantas
(74) *Attorney, Agent, or Firm* — McNeill Baur PLLC

(57) ABSTRACT

Provided herein are methods, compounds, and compositions for reducing expression of a nrRNA in an animal. Also provided herein are methods, compounds, and compositions for treating, ameliorating, delaying or reducing a symptom of a disease or disorder associated with a nuclear-retained RNA in an animal. Such methods, compounds, and compositions are useful to treat, prevent, delay, or ameliorate a disease or condition associated with a nuclear-retained RNA, or a symptom thereof.

20 Claims, 2 Drawing Sheets

Specification includes a Sequence Listing.

In vivo Reduction of U16 and U50 snoRNA in various tissues

MODULATION OF NUCLEAR-RETAINED RNA

STATEMENT OF GOVERNMENT SUPPORT

This invention was made with government support under NS072323 awarded by the National Institutes of Health. The government has certain rights in the invention.

SEQUENCE LISTING

The present application is being filed along with a Sequence Listing in electronic format. The Sequence Listing is provided as a file entitled BIOL0133USC1SEQ_ST25.txt created Jun. 28, 2017, which is approximately 784 kb in size. The information in the electronic format of the sequence listing is incorporated herein by reference in its entirety.

FIELD OF THE INVENTION

Provided herein are methods of achieving a pharmacologically relevant reduction of nuclear-retained RNAs and RNAs having a long residence time in the nucleus in a tissue having low antisense oligonucleotide uptake. Such methods are useful, for example, for treating, ameliorating, delaying or reducing a symptom of a disease or disorder in an animal associated with nuclear-retained RNAs and RNAs having a long residence time in the nucleus.

BACKGROUND

Systemic administration of antisense oligonucleotides produces high tissue concentration in liver and renal cortex, and moderate levels in some other tissues such as adipose, spleen and certain inflammatory cells. Uptake of 2'MOE gapmer oligonucleotides in spleen and inflammatory cells is typically 2 to 5-fold less than in the liver. In other tissues, including skeletal, smooth and cardiac muscle, tumor and brain, systemic administration of antisense oligonucleotides results in low to no accumulation of olignucleotide. The systemic delivery of 2'MOE gapmer oligonucleotides results in skeletal and cardiac muscle concentration that is approximately 50-fold lower than liver. Within tissue, the oligonucleotide distribution is heterogeneous with regard to cell type. For example, glomeruli, distal tubular epithelial cells and lymphocytes demonstrate lower uptake of oligonucleotide compared to other cells in kidney and lymphoid tissue. Pharmacodynamic effects are consistent with biodistribution data. Systemic administration of 2'MOE gapmer oligonucleotides produce modest target inhibition in skeletal or cardiac muscle in WT mice, even when targeting sequences are highly optimized. (Bennett C F. Pharmacological Properties of 2'-O-methoxyethyl-modified oligonucleotides. In: Crooke S T, ed. *Antisense Drug Technology: Principles, Strategies and Applications*. $2^{nd}$ ed. Boca Raton: CRC Press; 2008: 273-304.) Current efforts to reach targets in muscle and heart have been focused on modification of ASO chemistry or formulation and have yielded underwhelming results. As there are many diseases that manifest in tissues or cells that are resistant to oligonucleotide uptake, there remains a need to develop methods for effectively targeting disease associated genes in such tissues and cells.

SUMMARY OF THE INVENTION

Provided herein are methods of achieving a pharmacologically relevant reduction of a nuclear-retained RNA. In certain embodiments, the nuclear-retained RNA is in a tissue having low antisense oligonucleotide uptake. In certain embodiments, the methods comprise administering to an animal suspected of having said nuclear-retained RNA a chemically-modified antisense oligonucleotide complementary to said nuclear-retained RNA in an amount effective to activate a nuclear ribonuclease capable of cleaving the nuclear-retained RNA in said pharmacologically relevant amount. In certain embodiments, the nuclear-retained RNA is associated with a disease or condition in said tissue. In certain embodiments, an animal is selected as having a disease or condition associated with a nuclear-retained RNA.

Provided herein are methods of treating, ameliorating, delaying or reducing a symptom of a disease or disorder associated with a nuclear-retained RNA in a tissue having low antisense oligonucleotide uptake. In certain embodiments, the methods include selecting an animal having a disease or disorder associated with a nuclear-retained RNA in tissue having low antisense oligonucleotide uptake. In certain embodiments, the methods include administering to an animal a chemically-modified antisense oligonucleotide complementary to a nuclear-retained RNA in an amount effective to activate a nuclear ribonuclease capable of cleaving the nuclear-retained RNA in a pharmacologically relevant amount.

In certain embodiments, the tissue is skeletal muscle, cardiac muscle, smooth muscle, adipose, spleen, bone, intestine, adrenal, testes, ovary, pancreas, pituitary, prostate, skin, uterus, bladder, tumor and brain. In certain embodiments, the cell type is cells of the glomeruli, distal tubular epithelial cells and lymphocytes.

In certain embodiments, the administering results in a systemic effect of the oligonucleotide (an effect in more than one tissue). In certain embodiments, the administering is subcutaneous, intravenous, intracerebral, intracerebroventricular, intrathecal or another administration that result in a systemic effect of the oligonucleotide (an effect in more than one tissue) or delivery to the CNS or to the CSF.

Certain embodiments provide the use of any chemically-modified antisense oligonucleotide as described herein in the manufacture of a medicament for use in any of the therapeutic methods described herein.

Certain embodiments provide any chemically-modified antisense oligonucleotide as described herein, for use in any of the therapeutic methods described herein.

Chemically-modified oligonucleotides which can be used in the methods described herein are also provided.

DETAILED DESCRIPTION OF THE INVENTION

Figure 1A:
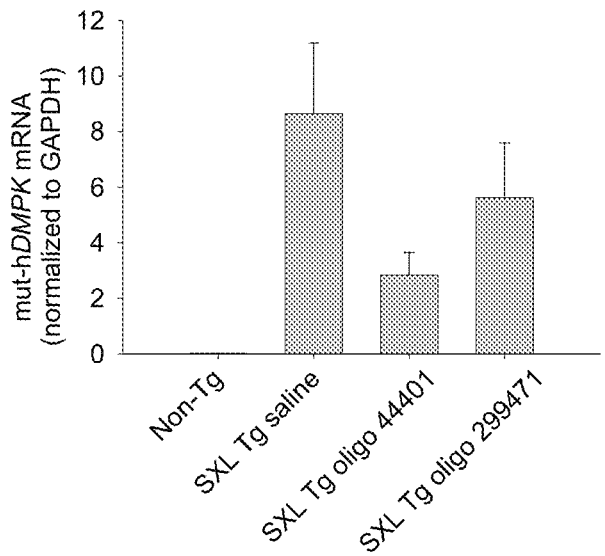
FIG. 1A shows the results of a Taqman assay for mut-hDMPK mRNA.

It is to be understood that both the foregoing general description and the following detailed description are exemplary and explanatory only and are not restrictive of the invention, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the animal matter described. All documents, or portions of documents, cited in this application, including, but not limited to, patents, patent applications, articles, books, and treatises, are hereby expressly incorporated-by-reference for the portions of the document discussed herein, as well as in their entirety.

Definitions

Unless specific definitions are provided, the nomenclature utilized in connection with, and the procedures and techniques of, analytical chemistry, synthetic organic chemistry, and medicinal and pharmaceutical chemistry described herein are those well known and commonly used in the art. Standard techniques can be used for chemical synthesis, and chemical analysis. Where permitted, all patents, applications, published applications and other publications, GENBANK Accession Numbers and associated sequence information obtainable through databases such as National Center for Biotechnology Information (NCBI) and other data referred to throughout in the disclosure herein are incorporated by reference for the portions of the document discussed herein, as well as in their entirety.

Unless otherwise indicated, the following terms have the following meanings:

"2'-O-methoxyethyl" (also 2'-MOE and 2'-O(CH$_2$)$_2$—OCH$_3$) refers to an O-methoxy-ethyl modification of the 2' position of a furosyl ring. A 2'-O-methoxyethyl modified sugar is a modified sugar.

"2'-O-methoxyethyl nucleotide" means a nucleotide comprising a 2'-O-methoxyethyl modified sugar moiety.

"5-methylcytosine" means a cytosine modified with a methyl group attached to the 5' position. A 5-methylcytosine is a modified nucleobase.

"Active pharmaceutical agent" means the substance or substances in a pharmaceutical composition that provide a therapeutic benefit when administered to an individual. For example, in certain embodiments an antisense oligonucleotide targeted to a nrRNA is an active pharmaceutical agent.

"Active target region" or "target region" means a region to which one or more active antisense compounds is targeted. "Active antisense compounds" means antisense compounds that reduce target nucleic acid levels or protein levels.

"Administered concomitantly" refers to the co-administration of two agents in any manner in which the pharmacological effects of both are manifest in the patient at the same time. Concomitant administration does not require that both agents be administered in a single pharmaceutical composition, in the same dosage form, or by the same route of administration. The effects of both agents need not manifest themselves at the same time. The effects need only be overlapping for a period of time and need not be coextensive.

"Administering" means providing an agent to an animal, and includes, but is not limited to, administering by a medical professional and self-administering.

"Agent" means an active substance that can provide a therapeutic benefit when administered to an animal. "First Agent" means a therapeutic compound of the invention. For example, a first agent can be an antisense oligonucleotide targeting a nrRNA. "Second agent" means a second therapeutic compound of the invention (e.g. a second antisense oligonucleotide targeting a nrRNA) and/or a non-a nrRNA therapeutic compound.

"Amelioration" refers to a lessening of at least one indicator, sign, or symptom of an associated disease, disorder, or condition. The severity of indicators can be determined by animalive or objective measures, which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antisense activity" means any detectable or measurable activity attributable to the hybridization of an antisense compound to its target nucleic acid. In certain embodiments, antisense activity is a decrease in the amount or expression of a target nucleic acid or protein encoded by such target nucleic acid.

"Antisense compound" means an oligomeric compound that is capable of undergoing hybridization to a target nucleic acid through hydrogen bonding.

"Antisense inhibition" means reduction of target nucleic acid levels or target protein levels in the presence of an antisense compound complementary to a target nucleic acid compared to target nucleic acid levels or target protein levels in the absence of the antisense compound.

"Antisense oligonucleotide" means a single-stranded oligonucleotide having a nucleobase sequence that permits hybridization to a corresponding region or segment of a target nucleic acid.

"Bicyclic sugar" means a furosyl ring modified by the bridging of two non-geminal ring atoms. A bicyclic sugar is a modified sugar.

"Bicyclic nucleic acid" or "BNA" refers to a nucleoside or nucleotide wherein the furanose portion of the nucleoside or nucleotide includes a bridge connecting two carbon atoms on the furanose ring, thereby forming a bicyclic ring system.

"Cap structure" or "terminal cap moiety" means chemical modifications, which have been incorporated at either terminus of an antisense compound.

"Chemically distinct region" refers to a region of an antisense compound that is in some way chemically different than another region of the same antisense compound. For example, a region having 2'-O-methoxyethyl nucleotides is chemically distinct from a region having nucleotides without 2'-O-methoxyethyl modifications.

"Chimeric antisense compound" means an antisense compound that has at least two chemically distinct regions.

"Co-administration" means administration of two or more agents to an individual. The two or more agents can be in a single pharmaceutical composition, or can be in separate pharmaceutical compositions. Each of the two or more agents can be administered through the same or different routes of administration. Co-administration encompasses parallel or sequential administration.

"Complementarity" means the capacity for pairing between nucleobases of a first nucleic acid and a second nucleic acid.

"Contiguous nucleobases" means nucleobases immediately adjacent to each other.

"Diluent" means an ingredient in a composition that lacks pharmacological activity, but is pharmaceutically necessary or desirable. For example, the diluent in an injected composition can be a liquid, e.g. saline solution.

"Dose" means a specified quantity of a pharmaceutical agent provided in a single administration, or in a specified time period. In certain embodiments, a dose can be administered in one, two, or more boluses, tablets, or injections. For example, in certain embodiments where subcutaneous administration is desired, the desired dose requires a volume not easily accommodated by a single injection, therefore, two or more injections can be used to achieve the desired dose. In certain embodiments, the pharmaceutical agent is administered by infusion over an extended period of time or continuously. Doses can be stated as the amount of pharmaceutical agent per hour, day, week, or month.

"Effective amount" or "therapeutically effective amount" means the amount of active pharmaceutical agent sufficient to effectuate a desired physiological outcome in an individual in need of the agent. The effective amount can vary among individuals depending on the health and physical condition of the individual to be treated, the taxonomic group of the individuals to be treated, the formulation of the composition, assessment of the individual's medical condition, and other relevant factors.

"Fully complementary" or "100% complementary" means each nucleobase of a nucleobase sequence of a first nucleic acid has a complementary nucleobase in a second nucleobase sequence of a second nucleic acid. In certain embodiments, a first nucleic acid is an antisense compound and a target nucleic acid is a second nucleic acid.

"Gapmer" means a chimeric antisense compound in which an internal region having a plurality of nucleosides that support RNase H cleavage is positioned between external regions having one or more nucleosides, wherein the nucleosides comprising the internal region are chemically distinct from the nucleoside or nucleosides comprising the external regions. The internal region can be referred to as a "gap segment" and the external regions can be referred to as "wing segments."

"Gap-widened" means a chimeric antisense compound having a gap segment of 12 or more contiguous 2'-deoxyribonucleosides positioned between and immediately adjacent to 5' and 3' wing segments having from one to six nucleosides.

"Hybridization" means the annealing of complementary nucleic acid molecules. In certain embodiments, complementary nucleic acid molecules include an antisense compound and a target nucleic acid.

"Identifying an animal with a disease or condition associated with a nuclear-retained RNA" means identifying an animal having been diagnosed with a disease or condition associated with a nuclear-retained RNA, disorder or condition or identifying an animal predisposed to develop a disease or condition associated with a nuclear-retained RNA, disorder or condition. For example, individuals with a familial history can be predisposed to a disease or condition associated with a nuclear-retained RNA, disorder or condition. Such identification can be accomplished by any method including evaluating an individual's medical history and standard clinical tests or assessments.

"Immediately adjacent" means there are no intervening elements between the immediately adjacent elements.

"Individual" means a human or non-human animal selected for treatment or therapy.

"Internucleoside linkage" refers to the chemical bond between nucleosides.

"Linked nucleosides" means adjacent nucleosides which are bonded together.

"Low uptake" or "resistant to uptake" means a cell or tissue that demonstrate low or reduced uptake of oligonucleotide or for which distribution or concentration of oligonucleotide is known to be low. In certain embodiments, a cell or tissue that has low uptake or is resistant to uptake of oligonucleotide has an oligonucleotide concentration after systemic administration that is at least 5-fold, 6-fold, 7-fold, 8-fold, 9-fold, 10-fold, 15-fold, 20-fold, 30-fold, 40-fold, 50-fold or 100-fold lower than liver or kidney concentration. In certain embodiments, a cell or tissue that has low uptake or is resistant to uptake of oligonucleotide demonstrates no measurable pharmacologically relevant effect upon systemic administration of an oligonucleotide targeting a non-stable (having low half-life or residence in nucleus) or non-nuclear-retained target.

"Mismatch" or "non-complementary nucleobase" refers to the case when a nucleobase of a first nucleic acid is not capable of pairing with the corresponding nucleobase of a second or target nucleic acid.

"Modified internucleoside linkage" refers to a substitution or any change from a naturally occurring internucleoside bond (i.e. a phosphodiester internucleoside bond).

"Modified nucleobase" refers to any nucleobase other than adenine, cytosine, guanine, thymidine, or uracil. An "unmodified nucleobase" means the purine bases adenine (A) and guanine (G), and the pyrimidine bases thymine (T), cytosine (C), and uracil (U).

"Modified nucleotide" means a nucleotide having, independently, a modified sugar moiety, modified internucleoside linkage, or modified nucleobase. A "modified nucleoside" means a nucleoside having, independently, a modified sugar moiety or modified nucleobase.

"Modified oligonucleotide" means an oligonucleotide comprising at least one modified nucleotide.

"Modified sugar" refers to a substitution or change from a natural sugar.

"Motif" means the pattern of chemically distinct regions in an antisense compound.

"Naturally occurring internucleoside linkage" means a 3' to 5' phosphodiester linkage.

"Natural sugar moiety" means a sugar found in DNA (2'-H) or RNA (2'-OH).

"Non-coding RNA" or "ncRNA" means a functional RNA molecule that is not translated into a protein. Non-coding RNA includes highly abundant and functionally important RNAs such as transfer RNA (tRNA) and ribosomal RNA (rRNA), as well as RNAs such as small nucleolar RNAs (snoRNAs), microRNAs, siRNAs and piRNAs and the long ncRNAs (or large ncRNAs). Long ncRNAs are generally considered to be non-protein coding transcripts longer than about 200 nucleotides and have been shown to play roles in regulation of gene transcription, post-transcriptional regulation and epigenetic regulation (see, e.g., Guttman, M. et al., *Nature.*, 2009, 458, 223-227). Long ncRNAs may include, but are not limited to promoter directed RNAs (pdRNAs) and lincRNAs.

"Nuclear-retained RNA" or "nrRNA" means RNA that is enriched or is stable in the nucleus. Nuclear-retained RNAs include, but are not limited to, non-coding RNA including long ncRNA such as lincRNA, repeat element containing RNA and expanded nucleotide repeat-containing RNA, small non-coding RNA (snRNA) including snoRNA and scaRNA (enrRNA) as described herein. In certain embodiments, a nrRNA is an RNA that resides only in the nucleus or is an RNA that pass briefly through the cytoplasm during maturation (export to the cytoplasm followed by import back to the nucleus) like some functional RNAs or can be an RNA that has a long residence time in the nucleus (for example, an RNA having a long half-life) but is exported to the cytoplasm after a period of time or certain event, such as, but not limited to, cleavage of a repeat element (e.g., Alu repeat element) in response to a stimulus (e.g., stress). In certain embodiments the nuclear-retained RNA is retained within a suborganell within the nucleus. Examples of nuclear retained RNAs include Xlsirt, Satellite III, Hox C5 transcript variant 2 (non-coding), Menβ, Neat1, Neat2, hsr-omega, hothead, Kit, Xist, Air, Tsix, Mirg, Kcnq1ot1, AK045070, P-rex1, ZNF127AS, NESPAS, SRG1, Hotair, Gomafu, Sox2ot, Rian, CAT2, Xite, Jpx, Ftx, RoX1, RoX2, H19, Igf2, IPW, UBE3A, ATP10C, pgc, 7SK, RNA Pol II transcription elongation factor P-TEFb, B2, HSR-1, BC1, BC200, NRSE, NRON, NFAT transcription factor, Makorin-p1, HAR1F, HAR1R, OCC1, DD3/PCA3, PCGEM1, NCRMS, HIS-1, BCMS, CMPD, NC612, SRA, DISC2, PSZA11q14, RAY1/ST7, UBE3A-AS, SCA8, 22k48, C6orf37OS, COPG2IT1, DGCR5, KCNQ1 overlapping transcript 1 (non-protein coding), MESTIT 1, PRINS, SCA8/ataxin 8, ATN1/DRPLA, FMR1, AFF2/FMR2, frataxin/FXN, Htt, junctophilin-3 (JPH3), DMPK, zinc finger protein-9, Androgen receptor (AR) (X-linked), ataxin-1 (ATXN1), ATXN10, protein phosphatase PP2A (PPP2R2B), TATA box-binding protein (TBP), ATXN2, ATXN3, CACNA1A, ATXN7, and SCA8.

"Nuclear ribonuclease" mean a ribonuclease found in the nucleus. Nuclear ribonucleases include, but are not limited to, RNase H including RNase H1 and RNase H2, the double stranded RNase drosha and other double stranded RNases.

"Nucleic acid" refers to molecules composed of monomeric nucleotides. A nucleic acid includes ribonucleic acids (RNA), deoxyribonucleic acids (DNA), single-stranded nucleic acids, double-stranded nucleic acids, small interfering ribonucleic acids (siRNA), and microRNAs (miRNA). A nucleic acid can also comprise a combination of these elements in a single molecule.

"Nucleobase" means a heterocyclic moiety capable of pairing with a base of another nucleic acid.

"Nucleobase sequence" means the order of contiguous nucleobases independent of any sugar, linkage, or nucleobase modification.

"Nucleoside" means a nucleobase linked to a sugar.

"Nucleoside mimetic" includes those structures used to replace the sugar or the sugar and the base and not necessarily the linkage at one or more positions of an oligomeric compound such as for example nucleoside mimetics having morpholino, cyclohexenyl, cyclohexyl, tetrahydropyranyl, bicyclo or tricyclo sugar mimetics e.g. non furanose sugar units.

"Nucleotide" means a nucleoside having a phosphate group covalently linked to the sugar portion of the nucleoside.

"Nucleotide mimetic" includes those structures used to replace the nucleoside and the linkage at one or more positions of an oligomeric compound such as for example peptide nucleic acids or morpholinos (morpholinos linked by —N(H)—C(=O)—O— or other non-phosphodiester linkage).

"Expanded Nucleotide repeat-containing RNA" (en-rRNA) means a mutant RNA molecule that contains a sequence of nucleotides comprising an expanded repeat element wherein a triplet or quartet of nucleotides is repeated consecutively several times within said sequence in greater number than normal affecting the normal processing of said RNA (see, e.g., Cooper, T. *Cell.*, 2009, 136, 777-793; O'Rourke, J. R., *J. Biol. Chem.*, 2009, 284 (12), 7419-7423).

"Oligomeric compound" or "oligomer" means a polymer of linked monomeric subunits which is capable of hybridizing to at least a region of a nucleic acid molecule.

"Oligonucleotide" means a polymer of linked nucleosides each of which can be modified or unmodified, independent one from another.

"Parenteral administration" means administration through injection or infusion. Parenteral administration includes subcutaneous administration, intravenous administration, intramuscular administration, intraarterial administration, intraperitoneal administration, or intracranial administration, e.g. intrathecal or intracerebroventricular administration. Administration can be continuous, or chronic, or short or intermittent.

"Peptide" means a molecule formed by linking at least two amino acids by amide bonds. Peptide refers to polypeptides and proteins.

"Pharmaceutical composition" means a mixture of substances suitable for administering to an individual. For example, a pharmaceutical composition can comprise one or more active agents and a sterile aqueous solution.

"Pharmaceutically acceptable dose" means a dose which can provide a pharmacologically relevant reduction of target and is well tolerated, having minimal, little or no toxicity.

"Pharmaceutically acceptable salts" means physiologically and pharmaceutically acceptable salts of antisense compounds, i.e., salts that retain the desired biological activity of the parent oligonucleotide and do not impart undesired toxicological effects thereto.

"Pharmacologically relevant reduction" means a reduction of an RNA that provides a pharmacological result. The pharmacological result can be, for example, amelioration of a disease or condition or a symptom of such disease or condition.

"Phosphorothioate linkage" means a linkage between nucleosides where the phosphodiester bond is modified by replacing one of the non-bridging oxygen atoms with a sulfur atom. A phosphorothioate linkage is a modified internucleoside linkage.

"Portion" means a defined number of contiguous (i.e. linked) nucleobases of a nucleic acid. In certain embodiments, a portion is a defined number of contiguous nucleobases of a target nucleic acid. In certain embodiments, a portion is a defined number of contiguous nucleobases of an antisense compound.

"Prevent" refers to delaying or forestalling the onset or development of a disease, disorder, or condition for a period of time from minutes to indefinitely. Prevent also means reducing risk of developing a disease, disorder, or condition.

"Prodrug" means a therapeutic agent that is prepared in an inactive form that is converted to an active form within the body or cells thereof by the action of endogenous enzymes or other chemicals or conditions.

"Side effects" means physiological responses attributable to a treatment other than the desired effects. In certain embodiments, side effects include injection site reactions, liver function test abnormalities, renal function abnormalities, liver toxicity, renal toxicity, central nervous system abnormalities, myopathies, and malaise. For example, increased aminotransferase levels in serum can indicate liver toxicity or liver function abnormality. For example, increased bilirubin can indicate liver toxicity or liver function abnormality.

"Single-stranded oligonucleotide" means an oligonucleotide which is not hybridized to a complementary strand.

"Specifically hybridizable" refers to an antisense compound having a sufficient degree of complementarity between an antisense oligonucleotide and a target nucleic acid to induce a desired effect, while exhibiting minimal or no effects on non-target nucleic acids under conditions in which specific binding is desired, i.e. under physiological conditions in the case of in vivo assays and therapeutic treatments.

"Stable RNA" means RNA with a long half-life or vary low turnover. In certain embodiments, a stable RNA has a half-life of at least 5 hours, 6 hours, 7 hours, 8 hours, 9 hours, 10 hours, 12 hours, 15 hours, 20 hours, 24 hours or greater than 24 hours. In certain embodiments, half-life is demonstrated by in vitro assays with RNA synthesis inhibitors such as actinomycin D or DRB (see Examples).

"Subcutaneous administration" means administration just below the skin.

"Sugar surrogate" overlaps with the slightly broader term "nucleoside mimetic" but is intended to indicate replacement of the sugar unit (furanose ring) only. The tetrahydropyranyl rings provided herein are illustrative of an example of a sugar surrogate wherein the furanose sugar group has been replaced with a tetrahydropyranyl ring system.

"Targeting" or "targeted" means the process of design and selection of an antisense compound that will specifically hybridize to a target nucleic acid and induce a desired effect.

"Target nucleic acid," "target RNA," and "target RNA transcript" all refer to a nucleic acid capable of being targeted by antisense compounds.

"Target segment" means the sequence of nucleotides of a target nucleic acid to which an antisense compound is targeted. "5' target site" refers to the 5'-most nucleotide of a target segment. "3' target site" refers to the 3'-most nucleotide of a target segment.

"Therapeutically effective amount" means an amount of an agent that provides a therapeutic benefit to an individual.

"Treat" refers to administering a pharmaceutical composition to effect an alteration or improvement of a disease, disorder, or condition.

"Unmodified nucleotide" means a nucleotide composed of naturally occurring nucleobases, sugar moieties, and internucleoside linkages. In certain embodiments, an unmodified nucleotide is an RNA nucleotide (i.e. β-D-ribonucleosides) or a DNA nucleotide (i.e. β-D-deoxyribonucleoside).

Certain Embodiments

Certain embodiments provide methods, compounds, and compositions for inhibiting a nuclear-retained RNA (nrRNA).

Certain embodiments provide a method of reducing a nrRNA in an animal including administering to the animal a compound comprising a modified antisense oligonucleotide targeted to the nrRNA.

In certain embodiments, the nrRNA is any of those provided herein, for example, any one of the targets listed in Table 1 or Table 2.

In certain embodiments, the nrRNA targeted and inhibited using the methods of the invention is a nrRNA selected from Xlsirt, Satellite III, Hox C5 transcript variant 2 (non-coding), Menβ, Neat1, Neat2, hsr-omega, hothead, Kit, Xist, Air, Tsix, Mirg, Kcnq1ot1, AK045070, P-rex1, ZNF127AS, NESPAS, SRG1, Hotair, Gomafu, Sox2ot, Rian, CAT2, Xite, Jpx, Ftx, RoX1, RoX2, H19, Igf2, IPW, UBE3A, ATP10C, pgc, 7SK, RNA Pol II transcription elongation factor P-TEFb, B2, HSR-1, BC1, BC200, NRSE, NRON, NFAT transcription factor, Makorin-p1, HAR1F, HAR1R, OCC1, DD3/PCA3, PCGEM1, NCRMS, HIS-1, BCMS, CMPD, NC612, SRA, DISC2, PSZA11q14, RAY1/ST7, UBE3A-AS, SCA8, 22k48, C6orf37OS, COPG2IT1, DGCR5, KCNQ1 overlapping transcript 1 (non-protein coding), MESTIT 1, PRINS, SCA8/ataxin 8, ATN1/DRPLA, FMR1, AFF2/FMR2, frataxin/FXN, Htt, junctophilin-3 (JPH3), DMPK, zinc finger protein-9, Androgen receptor (AR) (X-linked), ataxin-1 (ATXN1), ATXN10, protein phosphatase PP2A (PPP2R2B), TATA box-binding protein (TBP), ATXN2, ATXN3, CACNA1A, ATXN7, and SCA8. In certain embodiments, the nrRNA targeted and inhibited using the methods of the invention is a nrRNA selected from NEAT2 (aka MALAT1), DMPK, U16, and U 50. Certain embodiments provide a method of treating, ameliorating, delaying or reducing a symptom of a disease or disorder associated with a nuclear-retained RNA as described herein in an animal comprising administering to the animal a compound comprising a modified antisense oligonucleotide targeted to a nrRNA as described herein, wherein the modified oligonucleotide reduces a nrRNA in the animal, thereby treating, ameliorating, delaying or reducing a symptom of a disease or disorder associated with a nuclear-retained RNA in the animal.

Certain embodiments provide a method for treating an animal with a disease or condition associated with a nuclear-retained RNA including identifying said animal with a disease or condition associated with a nuclear-retained RNA, and administering to said animal a therapeutically effective amount of a compound comprising a modified oligonucleotide targeted to a nrRNA. In certain embodiments, the therapeutically effective amount of the compound administered to the animal treats, ameliorates, delays or reduces a symptom of a disease or disorder associated with a nuclear-retained RNA in the animal.

Certain embodiments provide a method of reducing a nrRNA comprising administering to an animal a compound comprising a modified oligonucleotide consisting of 10 to 30 linked nucleosides and having a nucleobase sequence at least 90% complementary to any one of the nrRNA sequences as described herein as measured over the entirety of said modified oligonucleotide. In certain embodiments, the reduction in a nrRNA treats, ameliorates, delays or reduces a symptom of a disease or disorder associated with a nuclear-retained RNA in the animal.

Certain embodiments provide a method for treating, ameliorating, delaying or reducing a symptom of a disease or condition associated with a nuclear-retained RNA. The method includes identifying an animal with a disease or condition associated with a nuclear-retained RNA, and administering to the animal a modified antisense oligonucleotide complementary to said nuclear-retained RNA in an amount effective to activate a nuclear ribonuclease in a tissue resistant to or having low uptake of oligonucleotide. The nuclear ribonuclease is capable of cleaving the nuclear-retained RNA by recognizing the antisense oligonucleotide/nrRNA duplex. In certain embodiments, the nuclear ribonuclease is RNase H1, RNase H2 or drosha. In certain embodiments, the amount of oligonucleotide is effective to reduce the nuclear-retained RNA by a pharmacologically relevant amount. In certain embodiments, the pharmacologically relevant reduction of nuclear-retained RNA treats, ameliorates, delays or reduces a symptom of a disease or disorder associated with a nuclear-retained RNA in the animal.

Certain embodiments provide a method of achieving a pharmacologically relevant reduction of a nuclear-retained RNA in a tissue having low antisense oligonucleotide uptake, comprising administering to an animal having or suspected of having the nuclear-retained RNA a modified antisense oligonucleotide targeted to or complementary to said nuclear-retained RNA in an amount effective to activate a nuclear ribonuclease capable of cleaving the nuclear-retained RNA in by a pharmacologically relevant amount. In certain embodiments, the nuclear-retained RNA is associated with a disease or condition in a tissue that has or demonstrates low oligonucleotide uptake or is resistant to oligonucleotide uptake and the animal is selected as having the associated disease or condition. In certain embodiments, the nuclear-retained RNA is a stable RNA.

Certain embodiments provide a method of treating, ameliorating, delaying or reducing a symptom of a disease or disorder associated with a nuclear-retained RNA in a tissue having low antisense oligonucleotide uptake, which includes selecting an animal having a disease or disorder associated with the nuclear-retained RNA in the tissue; and administering to the animal a modified antisense oligonucleotide targeted to or complementary to said nuclear-retained RNA in an amount effective to activate a nuclear ribonuclease capable of cleaving the nuclear-retained RNA in a pharmacologically relevant amount, thereby treating, ameliorating, delaying or reducing a symptom of the disease or disorder. In certain embodiments, the nuclear-retained RNA is a stable RNA.

In certain embodiments, the animal has a disease selected from Huntington's diseases, Huntington's disease-like 2, myotonic dystrophy (including DM1 and DM2), fragile X-associated tremor ataxia syndrome, Fragile XE mental retardation, spinocerebellar ataxias (including those listed in Table 2), Friedrich's ataxia, premature ovarian insufficiency, spinal and bulbar muscular atrophy, Spinal and bulbar muscular atrophy (Kennedy's disease) or dentarubral pallidoluysian atrophy (Haw river syndrome).

In certain embodiments, the tissue is skeletal muscle, cardiac muscle, smooth muscle, adipose, spleen, bone, intestine, adrenal, testes, ovary, pancreas, pituitary, prostate, skin, uterus, bladder, tumor and brain. In certain embodiments, the cell type is cells of the glomeruli, distal tubular epithelial cells and lymphocytes. In certain embodiments, the cell type is a malignant cell including, but not limited to, breast, lung, colon and prostate cancer cells.

In certain embodiments, the administering results in a systemic effect of the oligonucleotide (an effect in more than one tissue). In certain embodiments, the administering is subcutaneous, intravenous, intracerebral, intracerebroventricular, intrathecal or another administration that result in a systemic effect of the oligonucleotide (an effect in more than one tissue) or delivery to the CNS or to the CSF.

In certain embodiments, the nrRNA is a nucleotide repeat-containing RNA comprising at least one repeat region and at least one non-repeat region. In certain embodiments the repeat region of said nucleotide repeat-containing RNA comprises a repeat sequence selected from CAG, GCG, CUG, GCC, GCC, CGG, GAA, CAA, CCUG, or AUUCU. In certain embodiments, the repeat sequence is expanded. In certain embodiments, the repeat sequence repeats more than about 20, 25, 30, 35, 40, 45, 50, 55, 60, 65, 70, 75, 100, 250, 500, 1000, 1500, 2000 times (or any range defined by any two of these values) within the repeat region. In certain embodiments, the oligonucleotide targets a non-coding sequence within a non-repeat region of the nucleotide repeat-containing RNA. In certain embodiments, the oligonucleotide targets a coding region, an intron, a 5'UTR, or a 3'UTR of the nucleotide repeat-containing RNA.

In certain embodiments, the nrRNA is a non-coding RNA.

In certain embodiments, the nrRNA is a long ncRNA or lincRNA.

In certain embodiments, the nrRNA is a mutant RNA. In certain embodiments, the mutant RNA is preferentially lowered compared to wild-type.

In certain embodiments, the nrRNA is a stable RNA. In certain embodiments, the nrRNA has a half-life of at least 5 hours, 10 hours, 15 hours, 20 hours, 24 hours, greater than 24 hours, 25 hours or greater than 25 hours.

In certain embodiments, the oligonucleotide is chimeric. In certain embodiments the oligonucleotide is a gapmer.

In certain embodiments, the oligonucleotide consists of 10 to 30 linked nucleosides.

In certain embodiments, the oligonucleotide has a nucleobase sequence at least 90% complementary to the nrRNA as measured over the entirety of said modified oligonucleotide. In certain embodiments, the nucleobase sequence of the modified oligonucleotide is at least 95% complementary to any one of the nrRNAs as described herein. as measured over the entirety of said modified oligonucleotide. In certain embodiments, the nucleobase sequence of the modified oligonucleotide is 100% complementary to any one of the nrRNAs as described herein, as measured over the entirety of said modified oligonucleotide.

In certain embodiments, at least one internucleoside linkage of said modified oligonucleotide is a modified internucleoside linkage. In certain embodiments, each internucleoside linkage is a phosphorothioate internucleoside linkage.

In certain embodiments, at least one nucleoside of said modified oligonucleotide comprises a modified sugar. In certain embodiments, at least one modified sugar is a bicyclic sugar. In certain embodiments, at least one modified sugar comprises a 2'-O-methoxyethyl or a 4'-[C($R_a$)($R_b$)]$_n$—O-2' bridge, wherein Ra and Rb are independently H, alkyl or substituted alkyl. In certain embodiments, Ra and Rb are each H. In certain embodiments, Ra is an alkyl and Rb is H. In certain embodiments, Ra is CH3 and Rb is H. In certain embodiments, the modified sugar comprises a 4'-($CH_2$)$_n$—O-2' bridge, wherein n is 1 or 2.

In certain embodiments, at least one nucleoside of said modified oligonucleotide comprises a modified nucleobase. In certain embodiments, the modified nucleobase is a 5-methylcytosine.

In certain embodiments, the modified oligonucleotide comprises: a) a gap segment consisting of linked deoxynucleosides; b) a 5' wing segment consisting of linked nucleosides; and c) a 3' wing segment consisting of linked nucleosides. The gap segment is positioned between the 5' wing segment and the 3' wing segment and each nucleoside of each wing segment comprises a modified sugar.

In certain embodiments, the modified oligonucleotide comprises: a) a gap segment consisting of ten linked deoxynucleosides; b) a 5' wing segment consisting of five linked nucleosides; and c) a 3' wing segment consisting of five linked nucleosides. The gap segment is positioned between the 5' wing segment and the 3' wing segment, each nucleoside of each wing segment comprises a 2'-O-methoxyethyl sugar, each internucleoside linkage of said modified oligonucleotide is a phosphorothioate linkage, and each cytosine in said modified oligonucleotide is a 5'-methylcytosine.

In certain embodiments, the modified oligonucleotide consists of 20 linked nucleosides.

Certain embodiments provide a method of treating, ameliorating, delaying or reducing a symptom of a disease or disorder associated with a nuclear-retained RNA in an animal comprising administering to the animal a compound comprising a modified oligonucleotide which reduces a nrRNA, wherein the modified oligonucleotide comprises: a) a gap segment consisting of ten linked deoxynucleosides; b) a 5' wing segment consisting of five linked nucleosides; and c) a 3' wing segment consisting of five linked nucleosides.

The gap segment is positioned between the 5' wing segment and the 3' wing segment, each nucleoside of each wing segment comprises a 2'-O-methoxyethyl sugar, each internucleoside linkage of said modified oligonucleotide is a phosphorothioate linkage, each cytosine in said modified oligonucleotide is a 5'-methylcytosine and said reduction of a nrRNA treats, ameliorates, delays or reduces a symptom of a disease or disorder associated with a nuclear-retained RNA in the animal.

Certain embodiments provide the use of a compound as described herein in the manufacture of a medicament for treating, ameliorating, or preventing a disease or condition associated with a nuclear-retained RNA.

In certain embodiments, the modified oligonucleotide is designated as a first agent and the methods of the invention further comprise administering a second agent. In certain embodiments, the first agent and the second agent are co-administered. In certain embodiments the first agent and the second agent are co-administered sequentially or concomitantly.

Certain embodiments provide a kit for treating, preventing, or ameliorating a disease or condition associated with a nuclear-retained RNA as described herein wherein the kit comprises a compound as described herein; and optionally an additional agent or therapy as described herein. The kit can further include instructions or a label for using the kit to treat, prevent, or ameliorate a disease or condition associated with a nuclear-retained RNA.

Certain embodiments provide use of a modified antisense oligonucleotide as described herein for treatment of a disease associated with a nuclear-retained RNA in a tissue having low antisense oligonucleotide uptake. In certain embodiments, the use if for subcutaneous, intravenous, intracerebral, intracerebroventricular or intrathecal treatment or treatment of the CNS or the CSF.

Certain embodiments provide the use of any chemically-modified antisense oligonucleotide as described herein in the manufacture of a medicament for use in any of the therapeutic methods described herein.

Certain embodiments provide any chemically-modified antisense oligonucleotide as described herein, for use in any of the therapeutic methods described herein.

Certain embodiments provide a compound comprising a modified oligonucleotide consisting of 12 to 30 linked nucleosides having a nucleobase sequence comprising at least 12 contiguous nucleobases of any of the nucleobase sequences of 92-110, 150-160, and 171-175. In certain embodiments, the modified oligonucleotide has a nucleobase sequence comprising at least 8, at least 9, at least 10, or at least 11 contiguous nucleobases of any of the nucleobase sequences of 92-110, 150-160, and 171-175. In certain embodiments, the modified oligonucleotide has a nucleobase sequence comprising at least 13, at least 14, at least 15, at least 16, at least 17, at least 18, or at least 19, contiguous nucleobases of any of the nucleobase sequences of 92-110, 150-160, and 171-175.

In certain embodiments, the modified oligonucleotide is a single-stranded oligonucleotide.

In certain embodiments, the nucleobase sequence of the modified oligonucleotide is 100% complementary to SEQ ID NOs: 1, 177, and 198.

In certain embodiments, at least one internucleoside linkage is a modified internucleoside linkage.

In certain embodiments, each internucleoside linkage is a phosphorothioate internucleoside linkage.

In certain embodiments, at least one nucleoside comprises a modified sugar.

In certain embodiments, at least one modified sugar is a bicyclic sugar.

In certain embodiments, at least one modified sugar comprises a 2'-O-methoxyethyl.

In certain embodiments, at least one nucleoside comprises a modified nucleobase.

In certain embodiments, the modified nucleobase is a 5-methylcytosine.

In certain embodiments, the modified oligonucleotide comprises:
 a gap segment consisting of linked deoxynucleosides;
 a 5' wing segment consisting of linked nucleosides;
 a 3' wing segment consisting of linked nucleosides;
 wherein the gap segment is positioned between the 5' wing segment and the 3' wing segment and wherein each nucleoside of each wing segment comprises a modified sugar.

In certain embodiments, the modified oligonucleotide comprises:
 a gap segment consisting of ten linked deoxynucleosides;
 a 5' wing segment consisting of five linked nucleosides;
 a 3' wing segment consisting of five linked nucleosides;
 wherein the gap segment is positioned between the 5' wing segment and the 3' wing segment, wherein each nucleoside of each wing segment comprises a 2'-O-methoxyethyl sugar; and wherein each internucleoside linkage is a phosphorothioate linkage.

In certain embodiments, the modified oligonucleotide consists of 14 linked nucleosides.

In certain embodiments, the modified oligonucleotide consists of 16 linked nucleosides.

In certain embodiments, the modified oligonucleotide consists of 20 linked nucleosides.

Certain embodiments provide a pharmaceutical composition comprising a compound as described herein.

Nuclear Structures

Eukaryotic nuclei have a dynamic structural organization with several nuclear compartments and structures. The most prominent structure is the nucleolus, a non-membrane structure in which ribosomal RNA is transcribed and processed (Thiry, M. and Lanfontaine, D. L. J. Trends Cell Biol. 2005. 15: 194-199). Chromatin domains are also important structures which house the genomic DNA of the cell and regulate its expression (Cremer, T. et al., Crit. Rev. Eukaryotic Gene Expr. 2000. 10: 179-212).

The nucleus also contains speckles, or clusters of granules, of which interchromatin granules (ICGs) form a well-known class (Spector, D. L. et al., EMBO J. 1991. 10: 2467-3481), and which are the storage centres for various snRNAs, snRNPs (small nuclear RNA binding proteins), and RNA polymerase II (Fu, X. Y. and Maniatis, T. Nature. 1990. 343: 437-441). Many of the larger speckles correspond to interchromatin granule clusters (IGCs). These clusters measure 0.8-1.8 µm in diameter and are composed of 20-25-nm diameter particles that appear connected in places. IGCs have been proposed to be involved in the assembly and/or modification of pre-mRNA splicing factors.

Nuclear splicing speckles or interchromatin granule clusters (IGCs) also contain nuclear retained RNAs (Thiry, M. Eur. J. Cell. Biol. 1993. 62: 259-269). Certain nuclear retained RNAs remain in the nucleus for the duration of their life, and some of these may be released to the cytoplasm in response to certain signals, such as cellular stress. RNA is retained in the nucleus as a consequence of its editing by RNA adenosine deaminases and formation of large RNP complexes. Paraspeckles (PSs) are discrete nuclear bodies (Fox, A. H. et al., Mol. Biol. Cell 2005. 16: 5304-5315) often nearby or adjacent to splicing speckles, and also implicated in nuclear retention of certain RNAs. Studies (Clemenson, C. M. et al., Mol. Cell 2009. 33: 717-726; Sasaki, Y. T. et al., Proc. Natl. Acad. Sci. USA 2009. 106: 2525-2530; Sunwoo, H. et al., Genome Res. 2009. 19: 347-359) have shown the two non-coding RNAs, Menε/NEAT1 and Menβ, as structural elements, critical for the formation and maintenance of PSs.

Similar to PSs are the formation of stress nuclear bodies (SNBs), which similarly takes place at specific transcription sites around satellite repeat transcripts (Denegri, M. et al., Mol. Biol. Cell 2002. 13: 2069-2079; Jolly, C. et al., J. Cell Biol. 2002. 156: 775-781; Rizzi, N. et al., Mol. Cell Biol. 2004. 15: 543-551). SNBs are associated with factors in the regulation of RNA transcription and processing, though their actual role has not yet been elucidated.

Another nuclear domain, the perichromatin fibrils (PCFs), is distributed throughout the nucleus, and contains snRNPs, non-snRNPs and hnRNPs (Spector, D. L. Ann. Rev. Cell. Biol. 1993. 9: 265-315). These suggest that the PCFs are the sites of transcription and pre-mRNA processing (Fakan, S. et al., J. Cell Biol. 1984. 98: 358-363). Other such active nuclear sites are coiled bodies or Cajal bodies (CBs) (Lamond, A. I. and Carmo-Fonesca, M. Trends Cell Biol. 1993. 3: 198-204; Gall, J. G. Annu. Rev. Cell Dev. Biol. 2000. 16: 273-300) that are found in cells with a high RNA transcriptional/processing demand (Cajal, S. R. Trab. Lab Invest. Biol. Univ. Madrid 1903. 2: 129-221). CBs may represent domains that snRNPs would enter for maturation/recycling and leave to eventually integrate other functional domains, such as the splicing speckles or active transcriptional units.

Additional nuclear bodies are the perinuclear compartment (PNC) associated with the nucleolus and also implicated in RNA metabolism (Huang, S. J. Struct. Biol. 2000. 129: 233-240), granular and fibrillar regions of the nucleolus, promyelocytic leukemia protein (PML) nuclear bodies (Doucas, V. and Evans, R. M. Biochem. Biophys. Acta 1996. 1288: M25-M29), histone locus bodies, heat shock factor 1 foci, SAM-68 bodies, GATA-1 foci, and nuclear dots (Ascoli, C. A. and Maul, G. G. J. Cell Biol. 1991. 112: 785-795).

In certain embodiments, the nrRNA targeted in the methods described herein is contained in one of the subnuclear structures described herein, including, but not limited to, nucleoli, Cajal bodies, speckles, paraspeckles, stress nuclear bodies, perichromatin fibrils and perinuclear compartments. In certain embodiments, the nrRNA targeted in the methods described herein is associated with a ribonuclear protein or RNP complex.

Nuclear Retention

The cell nucleus, especially in mammalian cells, is a highly organized structure. Specific proteins and nucleic acids are enriched in subnuclear structures such as nucleoli, Cajal bodies, paraspeckles, and nuclear speckles (Platini and Lamond, 2004). Many of these structures are involved in control of gene expression through retention of RNA. The mechanism of nuclear retention is thought to be mediated by a number of structural features of RNA. For example, inosine-containing RNAs (or RNAs that undergo adenosine to inosine hyper editing) as well as RNAs with extended 3'UTRs and RNAs with inverted repeat elements, such as Alu elements, have been linked with nuclear retention (Bond and Fox 2009). RNAs with inverted repeats elements, such as Alu repeats, are shown to form double-stranded hairpins. These hairpins associate with ribonuclear proteins and can undergo adenosine to inosine (A to I) hyper editing (Zhang and Carmichael 2001; Bond and Fox, 2009). Other studies have also shown the importance of A-to-I editing in human RNAs as a reason for their stability (Athanasiadis, 2004; Kim, 2004). Other studies have shown that mutant expanded nucleotide repeat-containing RNAs form hairpins that associate with nuclear proteins or other proteins and thereby become sequestered or retained in the nucleus.

Thus, presence of an extended 3' UTR, presence of expanded or inverted repeat elements, presence of inosine or A to I editing of certain sequences and the binding of nucleoproteins to the RNA may be major contributing factors to nuclear retention or the increased stability of nuclear-retained RNAs.

In certain embodiments, the nrRNA targeted or provided in the methods as described herein has an extended 3' UTR. In certain embodiments, the nrRNA has one or more inverted repeat elements. In certain embodiments, the nrRNA contains inosine or undergoes A to I editing. In certain embodiments, the nrRNA binds nucleoproteins, ribonucleoproteins or snRNPs or a complex of any one or more thereof.

Stability of Nuclear Retained RNAs nrRNAs are generally understood to have greater stability compared to protein-coding RNAs. The comparative stability of nrRNAs is generally attributed to their structure as well as association with ribonucleoprotein complexes (Viegas, S. C. and Arraiano, C. M. RNA Biol. 2008. 5: 230-243). For example, the MALAT1 transcript, which has a long half-life, has a conserved genomically encoded short poly (A)-rich tract which yields a short poly(A) tail-like moiety at its 3'-end in the mature transcript. The presence of such short poly(A) tracts or tails have been previously shown to be effective at ensuring RNA stability (Peng, J. et al., RNA 2005. 11: 958-965). U-rich motifs are also believed to play a role in RNA stability. The presence of a poly(A) tail-like moiety and nearby U-rich motifs are believed to be the reason for the long half-life of MALAT-1 and its resistance to exonucleases (Wilusz J. E. et al., Cell 2008. 135: 919-932).

In certain embodiments, the nrRNA targeted or provided in the methods described herein includes a poly(A) tail or U-rich motifs.

Nuclear Retained RNAs

Non-Coding RNA

A large proportion of the mammalian genome is transcribed into long transcripts of RNA that do not get translated into protein. Such long non-coding RNA, previously considered as artifacts in the cell, are now beginning to be functionally characterized. Long non-coding RNA (long ncRNA) may serve one of many functions, such as structural, house-keeping, silencing by antisense or repression, and/or regulation of other gene expression. Mercer et al. (Mercer, T. R. et al., Proc. Natl. Acad. Sci. USA 2008. 105: 716-721) have identified 849 long ncRNAs that are expressed in the adult mouse brain and found that the majority of processed transcripts with no protein-coding capacity function intrinsically as RNAs. Guttman et al. (Guttman, M. et al., *Nature.*, 2009, 458, 223-227) have identified over a thousand long ncRNAs (large intervening non-coding RNAs or lincRNAs) and have assigned putative functions to each, demonstrating a diverse range of roles in processes from embryonic stem cell pluripotency to cell proliferation.

Long non-coding RNAs described in literature as possessing structural function are Neat1 (Clemson, C. M. et al., Mol. Cell 2009. 33: 717-726), Neat2/Malat-1 (Wilusz, J. E. et al., Cell 2008. 135: 919-932), hsr-omega (Lakhotia, S. C. et al., Curr. Sci. 1999. 77: 553-563), Xlsirt, which anchors other RNAs to the vegetal cortex in Xenopus oocytes (Kloc, M. and Etkin, L. D. Science 1994. 265: 1101-1103), Satellite III, which has been implicated in the establishment and maintenance of a specific chromatin structure at the 9q12 pericentromeric region during stress (Jolly, C. and Lakhotia, S. C. Nucleic Acids Res. 2006. 34: 5508-5514), and Menβ (Sasaki, Y. T. et al., Proc. Natl. Acad. Sci. USA 2009. 106: 2525-2530). Recent studies have implicated long ncRNAs as messengers of non-Mendelian inheritance of extragenomic information. Long ncRNAs hothead in *Arapidopsis thaliana* (Lolle, S. J. Nature 2005. 434: 505-509) and Kit in mouse (Rassoulzadegan, M. et al., Nature 2006. 441: 469-474) both function as alternate genome caches.

Computational analysis of data from large-scale sequencing projects has revealed an abundance of natural antisense transcripts in eukaryotic genomes (Lehner, B. et al., Trends Genet. 2002. 18: 63-65; Lavorgna, G. et al., Trends Biochem. Sci. 2004. 29: 88-94). More than 1600 transcripts have been identified as natural antisense transcripts in human (Yelin, R. et al., Nat. Biotechnol. 2003. 21: 379-386). These may be transcribed in cis or in trans. Non-coding RNAs described in literature as possessing antisense function are Xist, which has a role in X chromosome inactivation (Brockdorff N. et al., Cell 1992. 71: 515-526, Brown, C. J. et al., Cell 1992. 71: 527-542); Tsix (Lee, J. T. et al., Nat. Gen. 1999. 21: 400-404), which is antisense to Xist; Air, which silences autosomal genes of the paternal allele (Sleutels, F. et al., Nature 2002. 415: 810-813); Cop2as, which is antisense to the Copt gene and is maternally imprinted (Lee, Y. J. et al., FEBS Lett. 2000. 472: 230-234); Mirg, antisense to the Rtl1 gene which is paternally expressed (Seitz, H. et al., Nat. Genet. 2003. 34: 261-262); Kcnq1ot1, an antisense transcript that regulates lineage-specific silencing (Thakur, N. et al., Mol. Cell. Biol. 2004. 24: 7855-7862; Pandey, R. R. et al., Mol. Cell 2008. 32: 232-246); AK045070, which is antisense to the Coup-TfII gene; P-rex1AS, which is antisense to the P-rex1 gene (Mercer, T. R. et al., Proc. Natl. Acad. Sci. 2008. 105: 716-721); ZNF127AS, which is antisense to the ZNF127 gene (Jong 1999); NESPAS, antisense to the NESP55 gene (Wroe, S. F. et al., Proc. Natl. Acad. Sci. USA 2000. 97: 3342-3346); SRG1, which represses transcription of the SER3 gene in yeast (Martens, J. A. et al., Genes & Dev. 2004. 19: 2695-2704); antisense transcripts against the ErbAα2 mRNA in B cells (Hastings, M. L. et al., Nucleic Acids Res. 1997. 25: 4296-4300; Hastings, M. L. et al., J. Biol. Chem. 2000. 275: 11507-11513); the antisense transcript against the HFE mRNA, which is implicated in iron metabolism (Thenie, A. C. et al., Hum. Mol. Genet. 2001. 10: 1859-1866); the pseudo-NOS transcript, which is an antisense regulator of nNOS protein synthesis (Korneev, S. A. J Neurosci. 1999. 19: 7711-7720); and 231 known Hox ncRNAs, including Hotair, which represses transcription in trans of the HOXD locus (Rinn, J. L. et al., Cell 2007. 129: 1311-1323).

Non-coding RNAs may also regulate gene expression as dsRNAs, which also induce gene silencing via RNAi pathways. Such sense-antisense RNA-induced gene silencing has been well-documented (Aravin, A. A. Curr. Biol. 2001. 11: 1017-1027; Saito, K. et al., Genes & Dev. 2006. 20: 2214-2222; Vagin, V. V. et al., Science 2006. 313: 320-324). These transcripts in mammals are called piRNAs (Aravin, A. et al., Nature 2006. 442: 203-207; Girard, A. et al., Nature 2006. 442: 199-202) and are involved in germline-specific transcriptional and post-transcriptional gene silencing (Carthew, R. W. Science 2006. 313: 305-306; Lau, N. C. et al., Science 2006. 313: 363-367).

Other non-coding RNAs described in literature as possessing regulatory function are Evf (Feng, J. et al., Genes Dev. 2006. 20: 1470-1484), which interacts with homeobox transcription factor Dlx2; Glt2 (Schuster-Gossler, K. et al., Dev. Dyn. 1998. 212: 214-228),), which is involved in the regulation of the dwarfism phenotype; Gomafu (Sone, M. et al., J. Cell Sci. 2007. 120: 2498-2506), which is involved in gene expression in neurons; Sox2ot (Mikkelsen, T. S. et al., Nature 2007. 448: 553-560), which contains the Sox2 gene that is an important regulator of neurogenesis, AK021368, which encompasses mir-101a that regulates embryo implantation, the long ncRNA bidirectional to the Satb2 gene, which regulates chromatin modeling in cortical neurons, the long ncRNA bidirectional to Klhl14 gene, the long ncRNA bidirectional to Camkk1 gene, which is involved in male-specific memory formation (Mercer, T. R. et al., Proc. Natl. Acad. Sci. 2008. 105: 716-721), long ncRNA Rian, which is a maternally imprinted gene (Hatada, I. et al., J. Biochem. (Tokyo) 2001. 130: 187-190), CAT2 transcribed nuclear RNA, which regulates its protein-coding partner, the CAT2 gene (Prasanth, K. V. et al., Cell 2005. 123: 249-263), long ncRNAs Xite, Jpx and Ftx, which also regulates the Xist gene (Heard, E. and Disteche, C. M. Genes & Dev. 2006. 20: 1848-1867; Chureau, C. et al., Genome Res. 2002. 12: 894-908), long ncRNAs RoX1 and RoX2, which regulate expression of the male X chromosome (Deng, X. and Meller, V. H. Trends Biochem. Sci. 2006. 31: 526-532), long ncRNAs H19 which is a maternally imprinted gene and its corresponding paternally imprinted long ncRNA, Igf2 (Brannan, C. I. et al., Mol. Cell. Biol. 1990. 10: 28-36), the long ncRNA involved in Prader-Willi/Angelman syndrome, IPW (imprinted in Prader-Willi) (Wevrick, R. et al., Hum. Mol. Genet. 1994. 3: 1877-1882), the long ncRNA UBE3A, a maternally transcribed gene (Albrecht, U. et al., Nat. Genet. 1997. 17: 75-78), and ATP10C (Meguro, M. et al., Nat. Genet. 2001. 28: 19-20), long ncRNAs transcribed from the intergenic locus of β-globin in erythroid cells (Ashe, H. L. et al., Gens & Dev. 1997. 11: 2494-2509), long ncRNAs transcribed from the intergenic locus of IL4/IL13 loci of Th2 cells (Rogan, D. F. et al., Proc. Natl. Acad. Sci. USA. 2004. 101: 2446-2451), the miRNAs mir-iab-4-5p and mir-iab-4-3p, which regulate homeotic genes (Aravin, A. A. et al., Mol. Cell. Biol. 2003. 24: 6742-6750), the long ncRNA transcripts which regulate the TRE locus (Sanchez-Elsner, T. et al., Science. 2006. 311: 1118-1123) in *Drosophila*, long ncRNA pgc, which is involved in germ cell transcriptional inhibition in *Drosophila* (Nakamura, A. et al., Science 1996. 274: 2075-2079), 7SK, which binds to and inhibits RNA Pol II transcription elongation factor P-TEFb in mammals (Nguyen, V. T. et al., Nature 2001. 414: 322-325), long ncRNA B2 which is upregulated during environmental stresses in mouse and which inhibits RNA Pol II (Allen, T. A. et al., Nat. Struct. Mol. Biol. 2004. 11: 816-821), HSR-1 which activates heat-shock response (Shamovsky, I. et al., Nature 2006. 440: 556-560), long ncRNAs BC1 and BC200, which are targeted to the dendritic domains in neurons and implicated in fragile X syndrome (O'Donell, W. T. and Warren, S. T. Annu. Rev. Neurosci. 2002. 25: 315-338), NRSE which interacts with the NRSF/REST transcriptional machinery, resulting in the transition from neural stem cells to differentiated neurons (Kuwabara, T. et al., Cell 2004. 116: 779-793), viral long ncRNAs EBER1 and EBER2, which are expressed during viral latency in viruses like Epstein-Barr virus (Lerner, M. R. et al., Proc. Natl. Acad. Sci. USA 1981. 78: 805-809), and which also play a key role in the maintenance of the malignant phenotype of Burkitt's lymphoma cells (Nanbo, A. and Takada, K. Rev. Med. Virol. 2002. 12: 321-326), NRON, which is a repressor of the NFAT transcription factor (Willingham, A. T. et al., Science 2005. 309: 1570-1573), Makorin-p1, which stabilizes Makorin-1 mRNA (Yano, Y. et al., J. Mol. Med. 2004. 82: 414-422), long ncRNAs HAR1F and HAR1R, both of which are implicated in human brain evolution (Pollard, K. S. et al., Nature 2006. 443: 167-172), and the long ncRNAs PROMPTs, which are produced upstream of active transcription sites and which positively correlated to gene activity (Preker, P. et al., Science 2008. 322: 1851-1854).

Expression analyses comparing tumor cells with normal cells have demonstrated changes in the expression levels of certain long ncRNAs in several forms of cancer. The long ncRNAs reported are H19 in pediatric cancers (DeBaun, M. R. et al., Am. J. Hum. Genet. 2002. 70: 604-611), and Igf2 in Wilms' tumor and several fetal tumors (Okutsu, T. et al., J. Biochem. 2000. 127: 475-483), both of which have reduced expression in the tumor cells, OCC1, which is overexpressed in colon carcinoma (Pibouin, L. et al., Cancer Genet. Cytogenet. 2002. 133: 55-60), long ncRNAs DD3/PCA3 and PCGEM1, which are overexpressed in prostate tumors (Bussemakers, M. J. et al., Cancer Res. 1999. 59: 5975-5979), MALAT-1, which is overexpressed in non-small-cell lung cancer (Ji, P. et al., Oncogene 2003. 22: 8031-8041) and in uterine endometrial stromal sarcoma and hepatocellular carcinoma (Yamada, K. et al., Cancer Sci. 2006. 97: 106-112), NCRMS, which is overexpressed in alveolar rhabdomyosarcoma (Chan, A. S. et al., Oncogene 2002. 21: 3029-3037), HIS-1, which is implicated in lymphomagenesis and erythroleukemogenesis (Tam, W. et al., J. Virol. 2002. 76: 4275-4286), BC200, which is overexpressed in breast, cervix, esophagus, lung, ovary, parotid, and tongue cancers (Chen, W. et al., J. Pathol. 1997. 183: 345-351), BCMS, which is implicated in B-cell neoplasia (Wolf, S. et al., Hum. Mol. Genet. 2001. 10: 1275-1285), CMPD, which is implicated in Campomyelic dysplasia (Ninomiya, S. et al., Hum. Mol. Genet. 1996. 5: 69-72), HOST2, which is expressed in ovarian cancer cells (Rangel, L. B. et al., Oncogene 2003. 22: 7225-7232), NC612, which is implicated in prostate cancer (Silva, A. P. et al., Gene 2003. 310: 49-57), SRA, which is a steroid receptor activated RNA isoform expressed in breast cancer (Lanz, R. B. et al., Cell 1999. 97: 17-27), and TRNG10, which is implicated in various cancers (Roberts, T. et al., Hum. Mol. Genet. 1998. 7: 1169-1178).

Other long ncRNAs implicated in various disorders are BC200 in Alzheimer's disease (Lukiw, W. J. et al., Neurochem. Res. 1992. 17: 591-597), DISC2 in schizophrenia and bipolar affective disorder (Millar, J. K. et al., Hum. Mol. Genet. 2000. 9: 1415-1423; Millar J. K. et al., Ann. Med. 2004. 36: 367-378), IPW in Prader-Willi syndrome (Wevrick, R. et al., Hum. Mol. Genet. 1994. 3: 1877-1882), prion-associated RNAs in prion pathologies (Deleault, N. R. et al., Nature. 2003. 425: 717-720), PSZA11q14, which has reduced expression in the brains of schizophrenic patients (Polesskaya, O. O. et al., J. Neurosci. Res. 2003. 74: 111-122), RAY1/ST7 in autistic disorder (Vincent, J. B. et al., Genomics 2002. 80: 283-294), SCA8 in spinocerebellar ataxia type 8 (Nemes, J. P. et al., Hum. Mol. Genet. 2000. 9: 1543-1551), UBE3A-AS in Angelman syndrome (Chamberlain, S. J. and Brannan, C. I. Genomics 2001. 73: 316-322), ZNF127AS in Prader-Willi syndrome (Jong, M. T. et al., Hum. Mol. Genet. 1999. 8: 783-793), 22k48 in DiGeorge syndrome (Pizzuti, A. et al., Mol. Genet. Metab. 1999. 67: 227-235), C6orf37OS in diffuse panbronchiolitis (Matsuzaka, Y. et al., Immunogenetics 2002. 54: 301-309), COPG2IT1 in Russell-Silver syndrome (Yamasaki, K. et al., Genomics 2000. 68: 330-335), DGCR5, which is disrupted in DiGeorge syndrome (Sutherland, H. F. et al., Am. J. Hum. Genet. 1996. 59: 23-31), H19 and LIT1 in Beckwith-Wiedemann syndrome (Sparago, A. et al., Nat. Genet. 2004. 36: 958-960; Niemitz, E. L. et al., Am. J. Hum. Genet. 2004. 75: 844-849), LIT1 in Romano-Ward, Jervell and Lange-Nielsen syndromes (Horike, S. et al., Hum. Mol. Genet. 2000. 9: 2075-2083), MESTIT 1 in Russell-Silver syndrome (Li, T. et al., J. Biol. Chem. 2002. 277: 13518-13527), and PRINS in psoriasis (Sonkoly, E. et al., J. Biol. Chem. 2005. 280: 24159-24167).

Certain non-coding pri-miRNA precursors in the nucleus are also associated with disease and can be targeted by the methods provided herein. For example, BIC is a nuclear non-coding pri-miRNA precursor which is overexpressed in non-Hodgkin's lymphoma and Burkitt's lymphomas (van den Berg, A. et al., Genes Chromosomes Cancer 2003. 37: 20-28).

Small nucleolar RNAs (snoRNA) are another type of nuclear-retained non-coding RNA localized to the nucleolus inside the nucleus of eukaryotic cells. In certain instances, such snoRNA have been shown to be associated with precursors of ribosomal RNA (rRNA). Accordingly, certain snoRNAs have been reported to be involved in nucleotide modification and processing of pre-rRNA. The snoRNA U16 and U50 function in the modification of other small nuclear RNAs (Fragapane, P. et al., EMBO J. 12: 2921-2928, 1993; Tanaka, R. et al., Genes Cells. 5: 277-287, 2000). Nucleic acids have also been found in Cajal bodies within the nucleus. RNA found in Cajal bodies have been referred to as small Cajal body-specific RNA (scaRNA). Certain scaRNA have been reported to be involved in nucleotide modification of spliceosomal small nuclear RNAs (snRNAs). SnoRNA machinery has been implicated in human diseases such as Dyskeratosis congenital and Prader-Willi syndrome (Meier, U. T., Chromosoma 2005 114: 1-14).

TABLE 1

| Gene | Gene ID/Accession | Other Aliases | SEQ ID NO |
|---|---|---|---|
| Xlsirt | S67412 | | 1 |
| Satellite III | X06137.1 | SatIII, SatIII - repeat containing RNAs | 2 |
| Hox C5 transcript variant 2 (non-coding) | NR_003084 | Home box C5, mir-615 | 3 |
| Menβ | GQ859162.1 | | 4 |
| Neat1 | NR_002802.2 | Men ε | 5 |
| Neat2 | NR_002819.2 | Malat-1, metastasis associated lung adenocarcinoma transcript 1 (non-protein coding) | 6 |
| hsr-omega | NR_002068.3 | Hsromega; Heat shock RNA omega | 7 |
| hothead | NM_001160997.1 | HTH HTH (HOTHEAD); FAD binding/aldehyde-lyase/mandelonitrile lyase | 8 |
| Kit | NM_000222.1 | KIT; v-kit Hardy-Zuckerman 4 feline sarcoma viral oncogene homolog | 9 |
| Xist | NR_001564 | X (inactive)-specific transcript (non-protein coding) | 10 |
| Air | DQ220014.1 | air; aerotaxis receptor protein | 11 |
| Tsix | NR_002844.2 | X (inactive)-specific transcript, antisense | 12 |
| Mirg | NR_028265.1 | Mirg miRNA containing gene | 13 |
| Kcnq1ot1 | NR_002728 | KCNQ1 overlapping transcript 1 | 14 |
| AK045070 RIKEN | AK045070 | B130024G19Rik RIKEN cDNA B130024G19 gene | 15 |

TABLE 1-continued

| Gene | Gene ID/ Accession | Other Aliases | SEQ ID NO |
|---|---|---|---|
| P-rex1 | NM_020820 | phosphatidylinositol-3,4,5-trisphosphate-dependent Rac exchange factor 1 | 16 |
| ZNF127AS | AF130844.1 | MKRN3AS; MKRN3 antisense RNA (non-protein coding) | 17 |
| NESPAS | AJ251759 | neuroendocrine secretory protein antisense | 18 |
| SRG1 | NM_202885.2 | SRG1; (SENESCENCE-RELATED GENE 1 | 19 |
| Hotair | NR_003716 | hox transcript antisense RNA (non-protein coding) | 20 |
| Gomafu | NR_033657 | Miat; myocardial infarction associated transcript (non-protein coding) | 21 |
| Sox2ot | NR_004053 | SOX2OT; SOX2 overlapping transcript (non-protein coding) | 22 |
| Rian | NR_028261.1 | Rian; RNA imprinted and accumulated in nucleus | 23 |
| CAT2 | U35654.1 | mCat2; cationic amino acid transporter | 24 |
| Xite | AY190762.1 | Xite; X-inactivation intergenic transcription element | 25 |
| Jpx | AV714079 | NCRNA00183 non-protein coding RNA 183 | 26 |
| Ftx | NR_028379 | FTX; Thrombocytosis, familial X-linked, FLJ18387, NCRNA00182 | 27 |
| RoX1 | NR_002098.1 | roX1; RNA on the X 1 | 28 |
| RoX2 | NR_002105.1 | roX2; RNA on the X 2 | 29 |
| H19 | NR_002196.1 | H19; H19, imprinted maternally expressed transcript (non-protein coding) | 30 |
| Igf2 | NM_000612 | Igf2; insulin-like growth factor 2 | 31 |
| IPW | U12897 | IPW; imprinted in Prader-Willi syndrome (non-protein coding) | 32 |
| UBE3A | NM_000462 | Ube3a; ubiquitin protein ligase E3A | 33 |
| ATP10C | NM_024490 | ATP10C; ATPase, Class V, type 10C | 34 |
| pgc | NM_001103942.1 | pgc; polar granule component | 35 |
| 7SK | NR_001445.2 | RN7SK RNA, 7SK small nuclear | 36 |
| RNA Pol II transcription elongation factor P-TEFb | AF027300.1 | Positive transcription elongation factor b | 37 |
| B2 | | B2 hypothetical protein | |
| HSR-1 | U08215.1 | HSR1 similar to Candida troplicalis heat-shock related protein Hsr1p that confers salt tolerance to S. cerevisiae; potential HSF-type DNA binding transcription factor | 39 |
| BC1 | NR_033762.2 | Brain cytoplasmic RNA 1 | 40 |
| BC200 | NR_001568.1 | BCYRN1 brain cytoplasmic RNA 1 (non-protein coding) | 41 |
| NRSE | AX934359.1 | neuron-restrictive silencer element | 42 |
| NRON | AK042215.1 | non-protein coding RNA, represser of NFAT | 43 |
| NFAT transcription factor | NM_012340.3 | Rel NFAT transcription factor | 44 |
| Makorin-p1 | NM_013446 | Mkrn1 makorin, ring finger protein, 1 | 45 |
| HAR1F | NR_003244.1 | HAR1A highly accelerated region 1A (non-protein coding) | 46 |
| HAR1R | NR_003245 | HAR1B highly accelerated region 1B (non-protein coding) | 47 |
| OCC1 | AB039661.1 | 1500009L16Rik RIKEN cDNA 1500009L16 gene | 48 |
| DD3/PCA3 | NR_015342 | PCA3 prostate cancer antigen 3 (non-protein coding) | 49 |
| PCGEM1 | NR_002769 | PCGEM1 prostate-specific transcript 1 (non-protein coding) | 50 |
| NCRMS | NR_024037 | RMST rhabdomyosarcoma 2 associated transcript (non-protein coding) | 51 |
| HIS-1 | U09772.1 | His1 hematopoietic insertion site 1 | 52 |
| BCMS | NR_002605 | BCMS hypothetical LOC647154, DLB1 | 53 |
| CMPD | | cmpD bicarbonate transport system ATP-binding protein | |
| NC612 | AF510427 | Homo sapiens clone NC612 noncoding mRNA sequence | 55 |
| SRA | NM_001035235.2 | sra; sarah | 56 |
| DISC2 | NR_002227 | DISC2 disrupted in schizophrenia 2 (non-protein coding) | 57 |
| PSZA11q14 | AF525782 | DLG2AS DLG2 antisense RNA (non-protein coding) | 58 |
| RAY1/ST7 | NM_021908 | ST7 suppression of tumorigenicity 7 | 59 |
| UBE3A-AS | NG_002690 | Ube3a ubiquitin protein ligase E3A | |
| SCA8 | NR_002717 | sca8 cell surface antigen-like protein Sca8, KLHL1AS, ATXN8OS | 61 |
| ZNF127AS | AF130844.1 | MKRN3AS MKRN3 antisense RNA (non-protein coding) | 62 |
| 22k48 | AF093016 | Homo sapiens 22k48 gene, 5'UTR | 63 |
| C6orf37OS | NM_080870 | DPCR1 diffuse panbronchiolitis critical region 1, PBLT, bCX105N19.6 | 64 |
| COPG2IT1 | NR_024086 | COPG2IT1 COPG2 imprinted transcript 1 (non-protein coding) | 65 |
| DGCR5 | NR_002733 | DGCR5 DiGeorge syndrome critical region gene 5 (non-protein coding) | 66 |
| KCNQ1 overlapping transcript 1 (non-protein coding) | NR_002728 | KvDMR1, KvLQT1-AS, LIT1, NCRNA00012, | 67 |
| MESTIT 1 | AF482998 | Homo sapiens MESTIT1 antisense RNA, partial sequence | 68 |
| PRINS | NR_023388 | PRINS psoriasis associated RNA induced by stress (non-protein coding), NCRNA00074 | 69 |

Expanded Nucleotide Repeat-Containing RNAs

Mutant expanded nucleotide repeat-containing RNAs can form hairpins that associate with nuclear proteins or other proteins that become sequestered or retained in the nucleus. These expanded nucleotide repeat-containing RNAs (enrRNAs) are also referred to in the art as "gain-of-function RNAs" that gain the ability to sequester ribonuclear proteins and impair the normal action of RNA processing in the nucleus (see Cooper, T. (2009) Cell 136, 777-793; O'Rourke, J R (2009) J. Biol. Chem. 284 (12), 7419-7423). Several disease states are associated with enrRNAs, some of said diseases only occurring where a threshold number of repeats are contained within the enrRNA. For instance, one disease state might be caused by 50-200 repeats in a particular gene, where a different disease or severity is caused by a different number of repeats >400 in the same gene. Some mutations that caused enrRNAs can be heterozygous and therefore some copies of the gene can be functional and as a result, there is a need to interfere with the mutant version of the gene without affecting the wild type copy of the gene. Examples of nucleotide repeat-containing RNA molecules that can have expanded repeat elements implicated in disease are the following:

TABLE 2

| DISEASE | REPEAT | AFFECTED GENE | COPY NUMBER (NORMAL) | COPY NUMBER (DISEASED) | Reference | GENBANK Accession No | SEQ ID NO |
|---|---|---|---|---|---|---|---|
| Ataxin 8 opposite strand (ATXN8OS) | CUG with or without interruptions | SCA8/ataxin 8 | 16-37 | 107-127 | Nat. Genet 21: 379, 1999 (NCBI/OMIM) | NG_016173.1 | 70 |
| Atrophin 1 (DRPLA) | CAG | ATN1/DRPLA | 7 to 34 | 49-93 | Nat. Genet. 10: 99, 1995 | NM_001007026.1 | 71 |
| Fragile X-associated tremor/ataxia syndrome (FXTAS) | CGG | FMR1 | | 200-4500 | Annu. Rev. Neurosci. 25: 315, 2002 | NM_002024.5 | 72 |
| | | | <55 | >200 | Am. J Hum. Genet. 72: 869, 2003 (NCBI/OMIM) | | |
| Fragile XE mental retardation (FRAXE) | GCC | AFF2/FMR2 | 6 to 25 | >200 | Am. J. Hum. Genet. 55: 81, 1994 (NCBI/OMIM) | AB102644.1 | 73 |
| Friedreich's ataxia (FRDA) | GAA | frataxin/FXN | 5 to 30 | 70 to >1000 | Genomics 88: 580, 2006 (NCBI/OMIM) | BC048097.1 | 74 |
| Huntington disease | CAG | Htt | <28 | >36 | Lancet 369: 220, 2007 | NM_002111.6 | 75 |
| Huntington disease-like 2 (HDL2) | CAG/CUG | junctophilin-3 (JPH3) | 6 to 28 | 44 to 57 | Nat. Clin Prac Neurol. 3: 517, 2007 | AB042636.1 | 76 |
| Myotonic dystrophy (DM1) | CUG | DMPK | 5 TO 35 | 80 TO >2500 | Harper, Myotonic Dystrophy (Saunders, London, ed.3, 2001) | L19268.1 | 77 |
| | | | | 50 to >3500 | Annu. Rev. Neurosci. 29: 259, 2006 | | |
| | | | 5 to 37 | >50 | EMBO J. 19: 4439, 2000 | | |
| | | | | 50 to >2000 | Curr Opin Neurol. 20: 572, 2007 | | |
| DM2 | CCUG | zinc finger protein-9 | | 75 to 11,000 | Science 293: 864, 2001 (NCBI/OMIM) | NM_011763.2 | 78 |
| Spinal and bulbar muscular atrophy/Kennedy disease | CAG | Androgen receptor (AR) (X-linked) | 10 to 36 | 38 to 62 | Nature 352: 77, 1991 | M20132.1 | 79 |
| Spinocerebellar ataxia 1 | CAG | ataxin-1 (ATXN1) | 6 to 35 | 49 to 88 | NCBI/OMIM | NM_000332.3 | 80 |
| Spinocerebellar ataxia 10 | AUUCU | ATXN10 | 10 to 29 | 280 to 4500 | Neurology 66: 1602, 2006 (NCBI/OMIM) | BC007508.2 | 81 |
| Spinocerebellar ataxia 12 | CAG | protein phosphatase PP2A (PPP2R2B) | 9 to 28 | 55 to 78 | Brain Res Bull. 56: 397, 2001 | NM_004576.2 | 82 |
| | | | 7 to 28 | 66 to 78 | Wikipedia | | |
| Spinocerebellar ataxia 17/Huntington disease-like 4 (HDL4) | CAG | TATA box-binding protein (TBP) | 25 to 42 | 47 to 63 | Eur. J. Hum. Genet. 9: 160, 2001 (NCBI/OMIM) | M55654.1 | 83 |
| Spinocerebellar ataxia 2 | CAG | ATXN2 | 17 to 29 | 37 to 50 | Nat. Genet. 14: 285, 1996 (NCBI/OMIM) | NM_002973.3 | 84 |
| | | | 15 to 34 | 35 to 59 | Nat. Genet. 14: 277, 1996(NCBI/OMIM) | | |
| | | | 14 to 32 | 33 to 77 | Wikipedia | | |

TABLE 2-continued

| DISEASE | REPEAT | AFFECTED GENE | COPY NUMBER (NORMAL) | COPY NUMBER (DISEASED) | Reference | GENBANK Accession No | SEQ ID NO |
|---|---|---|---|---|---|---|---|
| Spinocerebellar ataxia 3 (Machado-Joseph disease | CAG | ATXN3 | 10 to 51<br>12 to 40 | 55-87<br>55 to 86 | Human Mol. Genet. 17: 2071, 2008 (NCBI/OMIM)<br>Wikipedia | AB050194.1 | 85 |
| Spinocerebel ataxia 6 | CAG | CACNA1A | 4 to 18<br>5 to 20 | 21 to 30<br>21 to 25 | Wikipedia<br>Am. J. Hum. Genet. 61: 336, 1997 (NCBI/OMIM) | FJ040507.1 | 86 |
| Spinocerebellar ataxia 7/OPCA3 | CAG | ATXN7 | 7 to 17 | 38-130 | Nat. Genet. 17: 65, 1997 (NCBI/OMIM) | AJ000517.1 | 87 |
| Spinocerebellar ataxia 8 | CUG | SCA8 | | 74 to >1300 | Nat. Genet. 21: 379, 1999 | AF126749.1 | 88 |

An example from the table is myotonic dystrophy type 1 (DM1). DM1, with an estimated frequency of 1 in 7,500, is an autosomal dominant disease that causes progressive disability and premature death. Skeletal, cardiac, and smooth muscle are affected. No treatment has been shown to modify the course of this disorder. The cause of DM1 is an expansion of CTG repeats in the 3' untranslated region (UTR) of DMPK, a gene encoding a cytosolic protein kinase. The mutation is unstable in dividing and post-mitotic cells, with a bias towards further expansion. Affected individuals typically have DMPK alleles with several thousand repeats in skeletal and cardiac muscle.

Research on DM1 has led to the discovery of RNA dominance, a disease process in which expression of RNA containing an expanded CUG repeat (CUGexp) induces cell dysfunction and ultimately cell degeneration in muscle. A critical step in this process is the interaction of CUG repeats with splicing factors in the Muscleblind-like (MBNL1) family. This interaction causes retention of CUGexp RNA in nuclear foci, which adversely effects transcriptional and post-transcriptional regulation of other genes. Treatment of the disease is complicated because the drug or agent must be taken up by muscle tissue. Oligonucleotide uptake in muscle tissue is very low.

Reduction of Nuclear-Retained RNA

Data provided herein demonstrates that sensitivity to cleavage by ASOs is dramatically increased for a nuclear-retained RNA making it possible to reduce nuclear-retained targets in tissue that has low uptake of oligonucleotide by a pharmacologically relevant amount. For example, out of the more than 4,000 transcripts that Isis has targeted by antisense, MALAT1, a non-coding, nuclear-retained RNA, is demonstrated to be one of the most sensitive targets for antisense oligonucleotide/RNase H inhibition. The data demonstrate a great number of oligonucleotides targeting over the majority of the transcript that inhibit by more than 50% in vitro. The data also demonstrates very low IC50 values in multiple cell types. Half-life studies have also shown that the MALAT1 is stable over a period of at least 10 hours. Subcutaneous administration of oligonucleotide targeting MALAT1 at doses commensurate with other oligonucleotide drugs (e.g., liver targeting drugs) achieved pharmacologically relevant reduction of MALAT1 in skeletal and cardiac muscle. Dosing at 50 mg/kg biweekly for 3.5 weeks achieved a 89% and 85% reduction in gastrocnemius and quadriceps, respectively, and 54% reduction in heart (as compared to 95% reduction in liver). Pharmacologically relevant reduction of MALAT1 has also been achieved in tumor xenograft models.

Where the nuclear-retained RNA is a mutant RNA, this sensitivity also provides a means to selectively reduce mutant RNA over wild-type. This approach is advantageous as the risk of inducing functional protein deficiency is reduced.

Antisense Compounds

Oligomeric compounds include, but are not limited to, oligonucleotides, oligonucleosides, oligonucleotide analogs, oligonucleotide mimetics, antisense compounds, antisense oligonucleotides, and siRNAs. An oligomeric compound can be "antisense" to a target nucleic acid, meaning that is capable of undergoing hybridization to a target nucleic acid through hydrogen bonding.

In certain embodiments, an antisense compound has a nucleobase sequence that, when written in the 5' to 3' direction, comprises the reverse complement of the target segment of a target nucleic acid to which it is targeted. In certain such embodiments, an antisense oligonucleotide has a nucleobase sequence that, when written in the 5' to 3' direction, comprises the reverse complement of the target segment of a target nucleic acid to which it is targeted.

In certain embodiments, an antisense compound targeted to a nrRNA nucleic acid is 10 to 30 nucleotides in length. In other words, antisense compounds are from 10 to 30 linked nucleobases. In other embodiments, the antisense compound comprises a modified oligonucleotide consisting of 8 to 80, 10-80, 12 to 50, 15 to 30, 18 to 24, 19 to 22, or 20 linked nucleobases. In certain such embodiments, the antisense compound comprises a modified oligonucleotide consisting of 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked nucleobases in length, or a range defined by any two of the above values.

In certain embodiments, the antisense compound comprises a shortened or truncated modified oligonucleotide. The shortened or truncated modified oligonucleotide can have a single nucleoside deleted from the 5' end (5' truncation), or alternatively from the 3' end (3' truncation). A shortened or truncated oligonucleotide can have two nucleosides deleted from the 5' end, or alternatively can have two subunits deleted from the 3' end. Alternatively, the deleted nucleosides can be dispersed throughout the modified oligonucleotide, for example, in an antisense compound having one nucleoside deleted from the 5' end and one nucleoside deleted from the 3' end.

When a single additional nucleoside is present in a lengthened oligonucleotide, the additional nucleoside can be located at the 5' or 3' end of the oligonucleotide. When two or more additional nucleosides are present, the added nucleosides can be adjacent to each other, for example, in an oligonucleotide having two nucleosides added to the 5' end (5' addition), or alternatively to the 3' end (3' addition), of the oligonucleotide. Alternatively, the added nucleoside can be dispersed throughout the antisense compound, for example, in an oligonucleotide having one nucleoside added to the 5' end and one subunit added to the 3' end.

It is possible to increase or decrease the length of an antisense compound, such as an antisense oligonucleotide, and/or introduce mismatch bases without eliminating activity. For example, in Woolf et al. (Proc. Natl. Acad. Sci. USA 89:7305-7309, 1992), a series of antisense oligonucleotides 13-25 nucleobases in length were tested for their ability to induce cleavage of a target RNA in an oocyte injection model. Antisense oligonucleotides 25 nucleobases in length with 8 or 11 mismatch bases near the ends of the antisense oligonucleotides were able to direct specific cleavage of the target mRNA, albeit to a lesser extent than the antisense oligonucleotides that contained no mismatches. Similarly, target specific cleavage was achieved using 13 nucleobase antisense oligonucleotides, including those with 1 or 3 mismatches.

Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo.

Maher and Dolnick (Nuc. Acid. Res. 16:3341-3358, 1988) tested a series of tandem 14 nucleobase antisense oligonucleotides, and a 28 and 42 nucleobase antisense oligonucleotides comprised of the sequence of two or three of the tandem antisense oligonucleotides, respectively, for their ability to arrest translation of human DHFR in a rabbit reticulocyte assay. Each of the three 14 nucleobase antisense oligonucleotides alone was able to inhibit translation, albeit at a more modest level than the 28 or 42 nucleobase antisense oligonucleotides.

Antisense Compound Motifs

In certain embodiments, antisense compounds targeted to a nrRNA nucleic acid have chemically modified subunits arranged in patterns, or motifs, to confer to the antisense compounds properties such as enhanced the inhibitory activity, increased binding affinity for a target nucleic acid, or resistance to degradation by in vivo nucleases.

Chimeric antisense compounds typically contain at least one region modified so as to confer increased resistance to nuclease degradation, increased cellular uptake, increased binding affinity for the target nucleic acid, and/or increased inhibitory activity. A second region of a chimeric antisense compound can optionally serve as a substrate for the nuclear ribonuclease RNase H, which cleaves the RNA strand of an RNA:DNA duplex.

Antisense compounds having a gapmer motif are considered chimeric antisense compounds. In a gapmer an internal region having a plurality of nucleotides that supports RNaseH cleavage is positioned between external regions having a plurality of nucleotides that are chemically distinct from the nucleosides of the internal region. In the case of an antisense oligonucleotide having a gapmer motif, the gap segment generally serves as the substrate for endonuclease cleavage, while the wing segments comprise modified nucleosides. In certain embodiments, the regions of a gapmer are differentiated by the types of sugar moieties comprising each distinct region. The types of sugar moieties that are used to differentiate the regions of a gapmer can in some embodiments include β-D-ribonucleosides, β-D-deoxyribonucleosides, 2'-modified nucleosides (such 2'-modified nucleosides can include 2'-MOE, and 2'-O—CH$_3$, among others), and bicyclic sugar modified nucleosides (such bicyclic sugar modified nucleosides can include those having a 4'-(CH2)n-O-2' bridge, where n=1 or n=2). Preferably, each distinct region comprises uniform sugar moieties. The wing-gap-wing motif is frequently described as "X-Y-Z", where "X" represents the length of the 5' wing region, "Y" represents the length of the gap region, and "Z" represents the length of the 3' wing region. As used herein, a gapmer described as "X-Y-Z" has a configuration such that the gap segment is positioned immediately adjacent each of the 5' wing segment and the 3' wing segment. Thus, no intervening nucleotides exist between the 5' wing segment and gap segment, or the gap segment and the 3' wing segment. Any of the antisense compounds described herein can have a gapmer motif. In some embodiments, X and Z are the same, in other embodiments they are different. In a preferred embodiment, Y is between 8 and 15 nucleotides. X, Y or Z can be any of 1, 2, 3, 4, 5, 6, 7, 8, 9, 10, 11, 12, 13, 14, 15, 16, 17, 18, 19, 20, 25, 30 or more nucleotides. Thus, gapmers include, but are not limited to, for example 5-10-5, 4-8-4, 4-12-3, 4-12-4, 3-14-3, 2-13-5, 2-16-2, 1-18-1, 3-10-3, 2-10-2, 1-10-1, 2-8-2, 6-8-6, 5-8-5, 1-8-1, or 2-6-2.

In certain embodiments, the antisense compound as a "wingmer" motif, having a wing-gap or gap-wing configuration, i.e. an X-Y or Y-Z configuration as described above for the gapmer configuration. Thus, wingmer configurations include, but are not limited to, for example 5-10, 8-4, 4-12, 12-4, 3-14, 16-2, 18-1, 10-3, 2-10, 1-10, 8-2, 2-13, or 5-13.

In certain embodiments, antisense compounds targeted to a nrRNA nucleic acid possess a 5-10-5 gapmer motif.

In certain embodiments, an antisense compound targeted to a nrRNA nucleic acid has a gap-widened motif.

Target Nucleic Acids, Target Regions and Nucleotide Sequences

Nucleotide sequences that encode a nrRNA include, without limitation, those described herein, including those listed in Table 1 and Table 2.

It is understood that the sequence set forth in each SEQ ID NO in the Examples contained herein is independent of any modification to a sugar moiety, an internucleoside linkage, or a nucleobase. As such, antisense compounds defined by a SEQ ID NO can comprise, independently, one or more modifications to a sugar moiety, an internucleoside linkage, or a nucleobase. Antisense compounds described by Isis Number (Isis No) indicate a combination of nucleobase sequence and motif.

In certain embodiments, a target region is a structurally defined region of the target nucleic acid. For example, a target region can encompass a 3' UTR, a 5' UTR, an exon, an intron, an exon/intron junction, a coding region, a translation initiation region, translation termination region, or other defined nucleic acid region. The structurally defined regions for a nrRNA can be obtained by accession number from sequence databases such as NCBI and such information is incorporated herein by reference. In certain embodiments, a target region can encompass the sequence from a 5' target site of one target segment within the target region to a 3' target site of another target segment within the target region.

Targeting includes determination of at least one target segment to which an antisense compound hybridizes, such that a desired effect occurs. In certain embodiments, the desired effect is a reduction in mRNA target nucleic acid levels. In certain embodiments, the desired effect is reduction of levels of protein encoded by the target nucleic acid or a phenotypic change associated with the target nucleic acid.

A target region can contain one or more target segments. Multiple target segments within a target region can be overlapping. Alternatively, they can be non-overlapping. In certain embodiments, target segments within a target region are separated by no more than about 300 nucleotides. In certain embodiments, target segments within a target region are separated by a number of nucleotides that is, is about, is no more than, is no more than about, 250, 200, 150, 100, 90, 80, 70, 60, 50, 40, 30, 20, or 10 nucleotides on the target nucleic acid, or is a range defined by any two of the preceding values. In certain embodiments, target segments within a target region are separated by no more than, or no more than about, 5 nucleotides on the target nucleic acid. In certain embodiments, target segments are contiguous. Contemplated are target regions defined by a range having a starting nucleic acid that is any of the 5' target sites or 3' target sites listed herein.

Suitable target segments can be found within a 5' UTR, a coding region, a 3' UTR, an intron, an exon, or an exon/intron junction. Target segments containing a start codon or a stop codon are also suitable target segments. A suitable target segment can specifically exclude a certain structurally defined region such as the start codon or stop codon.

The determination of suitable target segments can include a comparison of the sequence of a target nucleic acid to other sequences throughout the genome. For example, the BLAST algorithm can be used to identify regions of similarity amongst different nucleic acids. This comparison can prevent the selection of antisense compound sequences that can hybridize in a non-specific manner to sequences other than a selected target nucleic acid (i.e., non-target or off-target sequences).

There can be variation in activity (e.g., as defined by percent reduction of target nucleic acid levels) of the antisense compounds within an active target region. In certain embodiments, phenotypic changes, such as a treating, ameliorating, delaying or reducing a symptom of a disease or disorder associated with a nuclear-retained RNA, are indicative of inhibition of a nrRNA.

Hybridization

In some embodiments, hybridization occurs between an antisense compound disclosed herein and a nrRNA. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Stringent conditions are sequence-dependent and are determined by the nature and composition of the nucleic acid molecules to be hybridized.

Methods of determining whether a sequence is specifically hybridizable to a target nucleic acid are well known in the art (Sambrooke and Russell, Molecular Cloning: A Laboratory Manual, 3$^{rd}$ Ed., 2001). In certain embodiments, the antisense compounds provided herein are specifically hybridizable with a nrRNA.

Complementarity

An antisense compound and a target nucleic acid are complementary to each other when a sufficient number of nucleobases of the antisense compound can hydrogen bond with the corresponding nucleobases of the target nucleic acid, such that a desired effect will occur (e.g., antisense inhibition of a target nucleic acid, such as a nrRNA).

An antisense compound can hybridize over one or more segments of a nrRNA such that intervening or adjacent segments are not involved in the hybridization event (e.g., a loop structure, mismatch or hairpin structure).

In certain embodiments, the antisense compounds provided herein, or a specified portion thereof, are, or are at least 70%, 80%, 85%, 86%, 87%, 88, %, 89%, 90%, 91%, 92%, 93%, 94%, 95%, 96%, 97%, 98%, 99%, or 100% complementary to a nrRNA, a target region, target segment, or specified portion thereof. In certain embodiments, the antisense compounds are at least 70%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% complementary to a nrRNA, a target region, target segment, or specified portion thereof and contain at least 8, at least 9, at least 10, at least 11, at least 12, at least 13, at least 14, at least 15, at least 16, at least 17, at least 18, or at least 19, contiguous nucleobases of the nucleobase sequence of any of the exemplary antisense compounds described herein. Percent complementarity of an antisense compound with a target nucleic acid can be determined using routine methods.

For example, an antisense compound in which 18 of 20 nucleobases of the antisense compound are complementary to a target region, and would therefore specifically hybridize, would represent 90 percent complementarity. In this example, the remaining noncomplementary nucleobases can be clustered or interspersed with complementary nucleobases and need not be contiguous to each other or to complementary nucleobases. As such, an antisense compound which is 18 nucleobases in length having 4 (four) noncomplementary nucleobases which are flanked by two regions of complete complementarity with the target nucleic acid would have 77.8% overall complementarity with the target nucleic acid and would thus fall within the scope of the present invention. Percent complementarity of an antisense compound with a region of a target nucleic acid can be determined routinely using BLAST programs (basic local alignment search tools) and PowerBLAST programs known in the art (Altschul et al., J. Mol. Biol., 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, the antisense compounds provided herein, or specified portions thereof, are fully complementary (i.e. 100% complementary) to a target nucleic acid, or specified portion thereof. For example, antisense compound can be fully complementary to target nucleic acid, or a target region, or a target segment or target sequence thereof. As used herein, "fully complementary" means each nucleobase of an antisense compound is capable of precise base pairing with the corresponding nucleobases of a target nucleic acid. For example, a 20 nucleobase antisense compound is fully complementary to a target sequence that is 400 nucleobases long, so long as there is a corresponding 20 nucleobase portion of the target nucleic acid that is fully complementary to the antisense compound. Fully complementary can also be used in reference to a specified portion of the first and/or the second nucleic acid. For example, a 20 nucleobase portion of a 30 nucleobase antisense compound can be "fully complementary" to a target sequence that is 400 nucleobases long. The 20 nucleobase portion of the 30 nucleobase oligonucleotide is fully complementary to the target sequence if the target sequence has a corresponding 20 nucleobase portion wherein each nucleobase is complementary to the 20 nucleobase portion of the antisense compound. At the same time, the entire 30 nucleobase antisense compound can be fully complementary to the target sequence, depending on whether the remaining 10 nucleobases of the antisense compound are also complementary to the target sequence.

The location of a non-complementary nucleobase can be at the 5' end or 3' end of the antisense compound. Alternatively, the non-complementary nucleobase or nucleobases can be at an internal position of the antisense compound. When two or more non-complementary nucleobases are present, they can be either contiguous (i.e. linked) or non-contiguous. In one embodiment, a non-complementary nucleobase is located in the wing segment of a gapmer antisense oligonucleotide.

In certain embodiments, antisense compounds that are, or are up to 10, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a nrRNA, or specified portion thereof.

In certain embodiments, antisense compounds that are, or are up to 10, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a nrRNA, or specified portion thereof.

The antisense compounds provided herein also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of an antisense compound. In certain embodiments, the antisense compounds, are complementary to at least an 8 nucleobase portion of a target segment. In certain embodiments, the antisense compounds are complementary to at least a 10 nucleobase portion of a target segment. In certain embodiments, the antisense compounds are complementary to at least a 15 nucleobase portion of a target segment. Also contemplated are antisense compounds that are complementary to at least an 8, at least a 9, at least a 10, at least an 11, at least a 12, at least a 13, at least a 14, at least a 15, at least a 16, at least a 17, at least a 18, at least a 19, at least a 20, or more nucleobase portion of a target segment, or a range defined by any two of these values.

Identity

The antisense compounds provided herein can also have a defined percent identity to a particular nucleotide sequence, SEQ ID NO, or compound represented by a specific Isis number, or portion thereof. As used herein, an antisense compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the antisense compounds described herein as well as compounds having non-identical bases relative to the antisense compounds provided herein also are contemplated. The non-identical bases can be adjacent to each other or dispersed throughout the antisense compound. Percent identity of an antisense compound is calculated according to the number of bases that have identical base pairing relative to the sequence to which it is being compared.

In certain embodiments, the antisense compounds, or portions thereof, are at least 70%, at least 75%, at least 80%, at least 85%, at least 90%, at least 95%, at least 96%, at least 97%, at least 98%, at least 99%, or 100%, identical to one or more of the antisense compounds or SEQ ID NOs, or a portion thereof, disclosed herein.

Modifications

A nucleoside is a base-sugar combination. The nucleobase (also known as base) portion of the nucleoside is normally a heterocyclic base moiety. Nucleotides are nucleosides that further include a phosphate group covalently linked to the sugar portion of the nucleoside. For those nucleosides that include a pentofuranosyl sugar, the phosphate group can be linked to the 2', 3' or 5' hydroxyl moiety of the sugar. Oligonucleotides are formed through the covalent linkage of adjacent nucleosides to one another, to form a linear polymeric oligonucleotide. Within the oligonucleotide structure, the phosphate groups are commonly referred to as forming the internucleoside linkages of the oligonucleotide.

Modifications to antisense compounds encompass substitutions or changes to internucleoside linkages, sugar moieties, or nucleobases. Modified antisense compounds are often preferred over native forms because of desirable properties such as, for example, enhanced cellular uptake, enhanced affinity for nucleic acid target, increased stability in the presence of nucleases, or increased inhibitory activity.

Chemically modified nucleosides can also be employed to increase the binding affinity of a shortened or truncated antisense oligonucleotide for its target nucleic acid. Consequently, comparable results can often be obtained with shorter antisense compounds that have such chemically modified nucleosides.

Modified Internucleoside Linkages

The naturally occurring internucleoside linkage of RNA and DNA is a 3' to 5' phosphodiester linkage. Antisense compounds having one or more modified, i.e. non-naturally occurring, internucleoside linkages are often selected over antisense compounds having naturally occurring internucleoside linkages because of desirable properties such as, for example, enhanced cellular uptake, enhanced affinity for target nucleic acids, and increased stability in the presence of nucleases.

Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, antisense compounds targeted to a nrRNA comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

Modified Sugar Moieties

Antisense compounds of the invention can optionally contain one or more nucleosides wherein the sugar group has been modified. Such sugar modified nucleosides may impart enhanced nuclease stability, increased binding affinity, or some other beneficial biological property to the antisense compounds. In certain embodiments, nucleosides comprise a chemically modified ribofuranose ring moieties. Examples of chemically modified ribofuranose rings include without limitation, addition of substitutent groups (including 5' and 2' substituent groups, bridging of non-geminal ring atoms to form bicyclic nucleic acids (BNA), replacement of the ribosyl ring oxygen atom with S, N(R), or C(R1)(R)2 (R=H, C1-C12 alkyl or a protecting group) and combinations thereof. Examples of chemically modified sugars include 2'-F-5'-methyl substituted nucleoside (see PCT International Application WO 2008/101157 Published on Aug. 21, 2008 for other disclosed 5',2'-bis substituted nucleosides) or replacement of the ribosyl ring oxygen atom with S with further substitution at the 2'-position (see published U.S. Patent Application US2005-0130923, published on Jun. 16, 2005) or alternatively 5'-substitution of a BNA (see PCT International Application WO 2007/134181 Published on Nov. 22, 2007 wherein LNA is substituted with for example a 5'-methyl or a 5'-vinyl group).

Examples of nucleosides having modified sugar moieties include without limitation nucleosides comprising 5'-vinyl, 5'-methyl (R or S), 4'-S, 2'-F, 2'-OCH3 and 2'-O(CH2) 2OCH3 substituent groups. The substituent at the 2' position can also be selected from allyl, amino, azido, thio, O-allyl, O—C1-C10 alkyl, OCF3, O(CH2)2SCH3, O(CH2)2-O—N (Rm)(Rn), and O—CH2-C(=O)—N(Rm)(Rn), where each Rm and Rn is, independently, H or substituted or unsubstituted C1-C10 alkyl.

As used herein, "bicyclic nucleosides" refer to modified nucleosides comprising a bicyclic sugar moiety. Examples of bicyclic nucleosides include without limitation nucleosides comprising a bridge between the 4' and the 2' ribosyl ring atoms. In certain embodiments, antisense compounds provided herein include one or more bicyclic nucleosides wherein the bridge comprises a 4' to 2' bicyclic nucleoside. Examples of such 4' to 2' bicyclic nucleosides, include but are not limited to one of the formulae: 4'-(CH$_2$)—O-2' (LNA); 4'-(CH$_2$)—S-2'; 4'-(CH$_2$)$_2$—O-2' (ENA); 4'-CH (CH$_3$)—O-2' and 4'-CH(CH$_2$OCH$_3$)—O-2' (and analogs thereof see U.S. Pat. No. 7,399,845, issued on Jul. 15, 2008); 4'-C(CH$_3$)(CH$_3$)—O-2' (and analogs thereof see published International Application WO/2009/006478, published Jan. 8, 2009); 4'-CH$_2$—N(OCH$_3$)-2' (and analogs thereof see published International Application WO/2008/150729, published Dec. 11, 2008); 4'-CH$_2$—O—N(CH$_3$)-2' (see published U.S. Patent Application US2004-0171570, published Sep. 2, 2004); 4'-CH$_2$—N(R)—O-2', wherein R is H, C$_1$-C$_{12}$ alkyl, or a protecting group (see U.S. Pat. No. 7,427,672, issued on Sep. 23, 2008); 4'-CH$_2$—C(H)(CH$_3$)-2' (see Chattopadhyaya, et al., *J. Org. Chem.*, 2009, 74, 118-134); and 4'-CH$_2$—C(=CH$_2$)-2' (and analogs thereof see published International Application WO 2008/154401, published on Dec. 8, 2008). See, for example: Singh et al., *Chem. Commun.*, 1998, 4, 455-456; Koshkin et al., *Tetrahedron*, 1998, 54, 3607-3630; Wahlestedt et al., *Proc. Natl. Acad. Sci. U.S.A.*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 129(26) 8362-8379 (Jul. 4, 2007); U.S. Pat. Nos. 7,053,207; 6,268,490; 6,770,748; 6,794,499; 7,034,133; and 6,525,191; Elayadi et al., *Curr. Opinion Invens. Drugs*, 2001, 2, 558-561; Braasch et al., *Chem. Biol.*, 2001, 8, 1-7; and Orum et al., *Curr. Opinion Mol. Ther.*, 2001, 3, 239-243; and U.S. Pat. No. 6,670,461; International applications WO 2004/106356; WO 94/14226; WO 2005/021570; U.S. Patent Publication Nos. US2004-0171570; US2007-0287831; US2008-0039618; U.S. Pat. No. 7,399,845; U.S. patent Ser. Nos. 12/129,154; 60/989,574; 61/026,995; 61/026,998; 61/056,564; 61/086,231; 61/097,787; 61/099,844; PCT International Applications Nos. PCT/US2008/064591; PCT/US2008/066154; PCT/US2008/068922; and Published PCT International Applications WO 2007/134181. Each of the foregoing bicyclic nucleosides can be prepared having one or more stereochemical sugar configurations including for example α-L-ribofuranose and β-D-ribofuranose (see PCT international application PCT/DK98/00393, published on Mar. 25, 1999 as WO 99/14226).

In certain embodiments, bicyclic sugar moieties of BNA nucleosides include, but are not limited to, compounds having at least one bridge between the 4' and the 2' position of the pentofuranosyl sugar moiety wherein such bridges independently comprises 1 or from 2 to 4 linked groups independently selected from —[C(R$_a$)(R$_b$)]$_n$—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl or a protecting group.

In certain embodiments, the bridge of a bicyclic sugar moiety is, —[C(R$_a$)(R$_b$)]$_n$—, —[C(R$_a$)(R$_b$)]$_n$—O—, —C(R$_a$R$_b$)—N(R)—O— or —C(R$_a$R$_b$)—O—N(R)—. In certain embodiments, the bridge is 4'-CH$_2$-2', 4'-(CH$_2$)$_2$-2', 4'-(CH$_2$)$_3$-2', 4'-CH$_2$—O-2', 4'-(CH$_2$)$_2$—O-2', 4'-CH$_2$—O—N(R)-2' and 4'-CH$_2$—N(R)—O-2'- wherein each R is, independently, H, a protecting group or C$_1$-C$_{12}$ alkyl.

In certain embodiments, bicyclic nucleosides are further defined by isomeric configuration. For example, a nucleoside comprising a 4'-2' methylene-oxy bridge, may be in the α-L configuration or in the β-D configuration. Previously, α-L-methyleneoxy (4'-CH$_2$—O-2') BNA's have been incorporated into antisense oligonucleotides that showed antisense activity (Frieden et al., *Nucleic Acids Research*, 2003, 21, 6365-6372).

In certain embodiments, bicyclic nucleosides include, but are not limited to, (A) α-L-Methyleneoxy (4'-CH$_2$—O-2') BNA, (B) β-D-Methyleneoxy (4'-CH$_2$—O-2') BNA, (C) Ethyleneoxy (4'-(CH$_2$)$_2$—O-2') BNA, (D) Aminooxy (4'-CH$_2$—O—N(R)-2') BNA, (E) Oxyamino (4'-CH$_2$—N(R)—O-2') BNA, and (F) Methyl(methyleneoxy) (4'-CH(CH$_3$)—O-2') BNA, (G) methylene-thio (4'-CH$_2$—S-2') BNA, (H) methylene-amino (4'-CH$_2$—N(R)-2') BNA, (I) methyl carbocyclic (4'-CH$_2$—CH(CH$_3$)-2') BNA, and (J) propylene carbocyclic (4'-(CH$_2$)$_3$-2') BNA as depicted below.

(A)
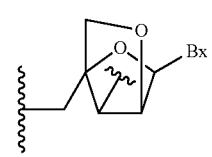

(B)
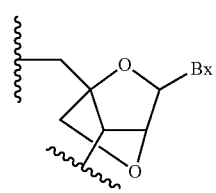

(C)
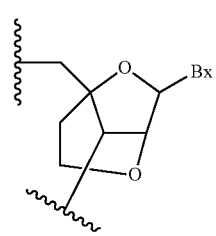

(D)
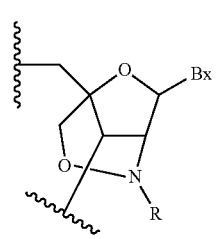

(E)
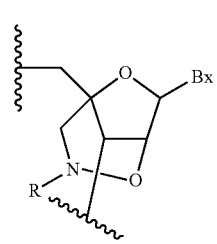

(F)
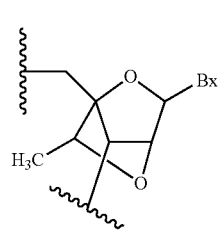

(G)
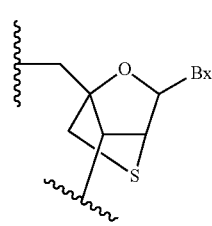

(H)
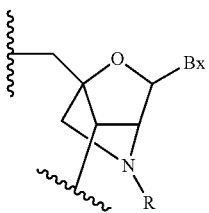

(I)
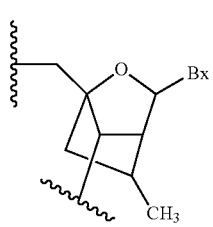

(J)
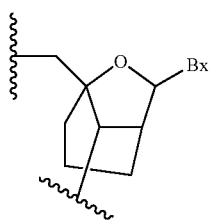

wherein Bx is the base moiety and R is independently H, a protecting group or C$_1$-C$_{12}$ alkyl.

In certain embodiments, bicyclic nucleoside having Formula I:

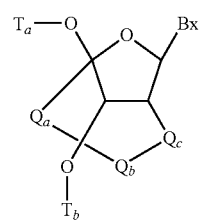

I wherein:
Bx is a heterocyclic base moiety;
-Q$_a$-Q$_b$-Q$_c$- is —CH$_2$—N(R$_c$)—CH$_2$—, —C(=O)—N(R$_c$)—CH$_2$—, —CH$_2$—O—N(R$_c$)—, —CH$_2$—N(R$_c$)—O— or —N(R$_c$)—O—CH$_2$;
R$_c$ is C$_1$-C$_{12}$ alkyl or an amino protecting group; and
T$_a$ and T$_b$ are each, independently H, a hydroxyl protecting group, a conjugate group, a reactive phosphorus group, a phosphorus moiety or a covalent attachment to a support medium.

In certain embodiments, bicyclic nucleoside having Formula II:

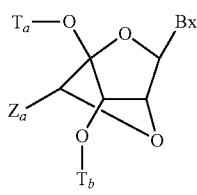

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$Z_a$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, acyl, substituted acyl, substituted amide, thiol or substituted thio.

In one embodiment, each of the substituted groups is, independently, mono or poly substituted with substituent groups independently selected from halogen, oxo, hydroxyl, $OJ_c$, $NJ_cJ_d$, $SJ_c$, $N_3$, $OC(=X)J_c$, and $NJ_eC(=X)NJ_cJ_d$, wherein each $J_c$, $J_d$ and $J_e$ is, independently, H, $C_1$-$C_6$ alkyl, or substituted $C_1$-$C_6$ alkyl and X is O or $NJ_c$.

In certain embodiments, bicyclic nucleoside having Formula III:

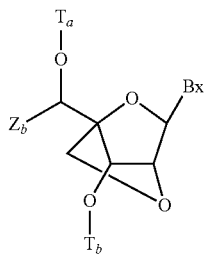

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$Z_b$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl or substituted acyl (C(=O)—).

In certain embodiments, bicyclic nucleoside having Formula IV:

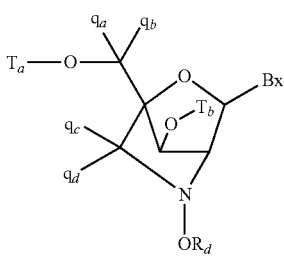

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$R_d$ is $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl;

each $q_a$, $q_b$, $q_c$ and $q_d$ is, independently, H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl, $C_1$-$C_6$ alkoxyl, substituted $C_1$-$C_6$ alkoxyl, acyl, substituted acyl, $C_1$-$C_6$ aminoalkyl or substituted $C_1$-$C_6$ aminoalkyl;

In certain embodiments, bicyclic nucleoside having Formula V:

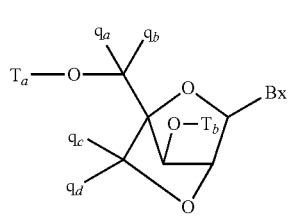

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$q_a$, $q_b$, $q_e$ and $q_f$ are each, independently, hydrogen, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxy, substituted $C_1$-$C_{12}$ alkoxy, $OJ_j$, $SJ_j$, $SOJ_j$, $SO_2J_j$, $NJ_jJ_k$, $N_3$, CN, $C(=O)OJ_j$, $C(=O)NJ_jJ_k$, $C(=O)J_j$, $O—C(=O)NJ_jJ_k$, $N(H)C(=NH)NJ_jJ_k$, $N(H)C(=O)NJ_jJ_k$ or $N(H)C(=S)NJ_jJ_k$;

or $q_e$ and $q_f$ together are $=C(q_g)(q_h)$;

$q_g$ and $q_h$ are each, independently, H, halogen, $C_1$-$C_{12}$ alkyl or substituted $C_1$-$C_{12}$ alkyl.

The synthesis and preparation of the methyleneoxy (4'-$CH_2$—O-2') BNA monomers adenine, cytosine, guanine, 5-methyl-cytosine, thymine and uracil, along with their oligomerization, and nucleic acid recognition properties have been described (Koshkin et al., *Tetrahedron*, 1998, 54, 3607-3630). BNAs and preparation thereof are also described in WO 98/39352 and WO 99/14226.

Analogs of methyleneoxy (4'-$CH_2$—O-2') BNA, methyleneoxy (4'-$CH_2$—O-2') BNA and 2'-thio-BNAs, have also been prepared (Kumar et al., *Bioorg. Med. Chem. Lett.*, 1998, 8, 2219-2222). Preparation of locked nucleoside analogs comprising oligodeoxyribonucleotide duplexes as substrates for nucleic acid polymerases has also been described (Wengel et al., WO 99/14226). Furthermore, synthesis of 2'-amino-BNA, a novel conformationally restricted high-affinity oligonucleotide analog has been described in the art (Singh et al., *J. Org. Chem.*, 1998, 63, 10035-10039). In addition, 2'-Amino- and 2'-methylamino-BNA's have been prepared and the thermal stability of their duplexes with complementary RNA and DNA strands has been previously reported.

In certain embodiments, bicyclic nucleoside having Formula VI:

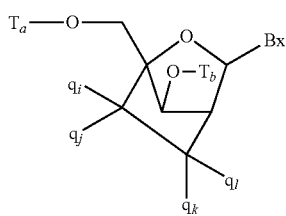

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

each $q_i$, $q_j$, $q_k$ and $q_l$ is, independently, H, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxyl, substituted $C_1$-$C_{12}$ alkoxyl, $OJ_j$, $SJ_j$, $SOJ_j$, $SO_2J_j$, $NJ_jJ_k$, $N_3$, CN, C(=O)$OJ_j$, C(=O)$NJ_jJ_k$, C(=O)$J_j$, O—C(=O)$NJ_jJ_k$, N(H)C(=NH)$NJ_jJ_k$, N(H)C(=O)$NJ_jJ_k$ or N(H)C(=S)$NJ_jJ_k$; and $q_i$ and $q_j$ or $q_l$ and $q_k$ together are =C($q_g$)($q_h$), wherein $q_g$ and $q_h$ are each, independently, H, halogen, $C_1$-$C_{12}$ alkyl or substituted $C_1$-$C_{12}$ alkyl.

One carbocyclic bicyclic nucleoside having a 4'-(CH$_2$)$_3$-2' bridge and the alkenyl analog bridge 4'-CH=CH—CH$_2$-2' have been described (Freier et al., *Nucleic Acids Research*, 1997, 25(22), 4429-4443 and Albaek et al., *J. Org. Chem.*, 2006, 71, 7731-7740). The synthesis and preparation of carbocyclic bicyclic nucleosides along with their oligomerization and biochemical studies have also been described (Srivastava et al., *J. Am. Chem. Soc.* 2007, 129(26), 8362-8379).

As used herein, "4'-2' bicyclic nucleoside" or "4' to 2' bicyclic nucleoside" refers to a bicyclic nucleoside comprising a furanose ring comprising a bridge connecting two carbon atoms of the furanose ring connects the 2' carbon atom and the 4' carbon atom of the sugar ring.

As used herein, "monocyclic nucleosides" refer to nucleosides comprising modified sugar moieties that are not bicyclic sugar moieties. In certain embodiments, the sugar moiety, or sugar moiety analogue, of a nucleoside may be modified or substituted at any position.

As used herein, "2'-modified sugar" means a furanosyl sugar modified at the 2' position. In certain embodiments, such modifications include substituents selected from: a halide, including, but not limited to substituted and unsubstituted alkoxy, substituted and unsubstituted thioalkyl, substituted and unsubstituted amino alkyl, substituted and unsubstituted alkyl, substituted and unsubstituted allyl, and substituted and unsubstituted alkynyl. In certain embodiments, 2' modifications are selected from substituents including, but not limited to: O[(CH$_2$)$_n$O]$_m$CH$_3$, O(CH$_2$)$_n$NH$_2$, O(CH$_2$)$_n$CH$_3$, O(CH$_2$)$_n$ONH$_2$, OCH$_2$C(=O)N(H)CH$_3$, and O(CH$_2$)$_n$ON[(CH$_2$)$_n$CH$_3$]$_2$, where n and m are from 1 to about 10. Other 2'-substituent groups can also be selected from: $C_1$-$C_{12}$ alkyl, substituted alkyl, alkenyl, alkynyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving pharmacokinetic properties, or a group for improving the pharmacodynamic properties of an antisense compound, and other substituents having similar properties. In certain embodiments, modified nucleosides comprise a 2'-MOE side chain (Baker et al., *J. Biol. Chem.*, 1997, 272, 11944-12000). Such 2'-MOE substitution have been described as having improved binding affinity compared to unmodified nucleosides and to other modified nucleosides, such as 2'-O-methyl, O-propyl, and O-aminopropyl. Oligonucleotides having the 2'-MOE substituent also have been shown to be antisense inhibitors of gene expression with promising features for in vivo use (Martin, P., *Helv. Chim. Acta*, 1995, 78, 486-504; Altmann et al., *Chimia*, 1996, 50, 168-176; Altmann et al., *Biochem. Soc. Trans.*, 1996, 24, 630-637; and Altmann et al., *Nucleosides Nucleotides*, 1997, 16, 917-926).

As used herein, a "modified tetrahydropyran nucleoside" or "modified THP nucleoside" means a nucleoside having a six-membered tetrahydropyran "sugar" substituted in for the pentofuranosyl residue in normal nucleosides (a sugar surrogate). Modified THP nucleosides include, but are not limited to, what is referred to in the art as hexitol nucleic acid (HNA), anitol nucleic acid (ANA), mannitol nucleic acid (MNA) (see Leumann, C J. *Bioorg. & Med. Chem.* (2002) 10:841-854), fluoro HNA (F-HNA) or those compounds having Formula X:

Formula X

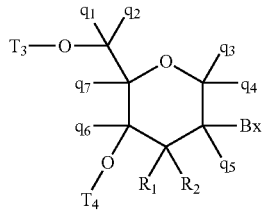

wherein independently for each of said at least one tetrahydropyran nucleoside analog of Formula X:

Bx is a heterocyclic base moiety;

$T_3$ and $T_4$ are each, independently, an internucleoside linking group linking the tetrahydropyran nucleoside analog to the antisense compound or one of $T_3$ and $T_4$ is an internucleoside linking group linking the tetrahydropyran nucleoside analog to the antisense compound and the other of $T_3$ and $T_4$ is H, a hydroxyl protecting group, a linked conjugate group or a 5' or 3'-terminal group;

$q_1$, $q_2$, $q_3$, $q_4$, $q_5$, $q_6$ and $q_7$ are each independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl; and each of $R_1$ and $R_2$ is selected from hydrogen, hydroxyl, halogen, substituted or unsubstituted alkoxy, $NJ_1J_2$, $SJ_1$, $N_3$, OC(=X)$J_1$, OC(=X)$NJ_1J_2$, $NJ_3$C(=X)$NJ_1J_2$ and CN, wherein X is O, S or $NJ_1$ and each $J_1$, $J_2$ and $J_3$ is, independently, H or $C_1$-$C_6$ alkyl.

In certain embodiments, the modified THP nucleosides of Formula X are provided wherein $q_m$, $q_n$, $q_p$, $q_r$, $q_s$, $q_t$ and $q_u$ are each H. In certain embodiments, at least one of $q_m$, $q_n$, $q_p$, $q_r$, $q_s$, $q_t$ and $q_u$ is other than H. In certain embodiments, at least one of $q_m$, $q_n$, $q_p$, $q_r$, $q_s$, $q_t$ and $q_u$ is methyl. In certain embodiments, THP nucleosides of Formula X are provided wherein one of $R_1$ and $R_2$ is F. In certain embodiments, $R_1$ is fluoro and $R_2$ is H; $R_1$ is methoxy and $R_2$ is H, and $R_1$ is methoxyethoxy and $R_2$ is H.

As used herein, "2'-modified" or "2'-substituted" refers to a nucleoside comprising a sugar comprising a substituent at the 2' position other than H or OH. 2'-modified nucleosides, include, but are not limited to, bicyclic nucleosides wherein the bridge connecting two carbon atoms of the sugar ring connects the 2' carbon and another carbon of the sugar ring; and nucleosides with non-bridging 2'substituents, such as allyl, amino, azido, thio, O-allyl, O—$C_1$-$C_{10}$ alkyl, —$OCF_3$, O—$(CH_2)_2$—O—$CH_3$, 2'-O$(CH_2)_2SCH_3$, O—$(CH_2)_2$—O—$N(R_m)(R_n)$, or O—$CH_2$—C(=O)—$N(R_m)(R_n)$, where each $R_m$ and $R_n$ is, independently, H or substituted or unsubstituted $C_1$-$C_{10}$ alkyl. 2'-modified nucleosides may further comprise other modifications, for example at other positions of the sugar and/or at the nucleobase.

As used herein, "2'-F" refers to a nucleoside comprising a sugar comprising a fluoro group at the 2' position.

As used herein, "2'-OMe" or "2'-$OCH_3$" or "2'-O-methyl" each refers to a nucleoside comprising a sugar comprising an —$OCH_3$ group at the 2' position of the sugar ring.

As used herein, "MOE" or "2'-MOE" or "2'-$OCH_2CH_2OCH_3$" or "2'-O-methoxyethyl" each refers to a nucleoside comprising a sugar comprising a —$OCH_2CH_2OCH_3$ group at the 2' position of the sugar ring.

As used herein, "oligonucleotide" refers to a compound comprising a plurality of linked nucleosides. In certain embodiments, one or more of the plurality of nucleosides is modified. In certain embodiments, an oligonucleotide comprises one or more ribonucleosides (RNA) and/or deoxyribonucleosides (DNA).

Many other bicyclo and tricyclo sugar surrogate ring systems are also known in the art that can be used to modify nucleosides for incorporation into antisense compounds (see for example review article: Leumann, J. C, *Bioorganic & Medicinal Chemistry*, 2002, 10, 841-854).

Such ring systems can undergo various additional substitutions to enhance activity.

Methods for the preparations of modified sugars are well known to those skilled in the art.

In nucleotides having modified sugar moieties, the nucleobase moieties (natural, modified or a combination thereof) are maintained for hybridization with an appropriate nucleic acid target.

In certain embodiments, antisense compounds comprise one or more nucleotides having modified sugar moieties. In certain embodiments, the modified sugar moiety is 2'-MOE. In certain embodiments, the 2'-MOE modified nucleotides are arranged in a gapmer motif. In certain embodiments, the modified sugar moiety is a cEt. In certain embodiments, the cEt modified nucleotides are arranged throughout the wings of a gapmer motif.

Modified Nucleobases

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can impart nuclease stability, binding affinity or some other beneficial biological property to antisense compounds. Modified nucleobases include synthetic and natural nucleobases such as, for example, 5-methylcytosine (5-me-C). Certain nucleobase substitutions, including 5-methylcytosine substitutions, are particularly useful for increasing the binding affinity of an antisense compound for a target nucleic acid. For example, 5-methylcytosine substitutions have been shown to increase nucleic acid duplex stability by 0.6-1.2° C. (Sanghvi, Y. S., Crooke, S. T. and Lebleu, B., eds., Antisense Research and Applications, CRC Press, Boca Raton, 1993, pp. 276-278).

Additional unmodified nucleobases include 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl (—C≡C—CH3) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine.

Heterocyclic base moieties can also include those in which the purine or pyrimidine base is replaced with other heterocycles, for example 7-deaza-adenine, 7-deazaguanosine, 2-aminopyridine and 2-pyridone. Nucleobases that are particularly useful for increasing the binding affinity of antisense compounds include 5-substituted pyrimidines, 6-azapyrimidines and N-2, N-6 and O-6 substituted purines, including 2 aminopropyladenine, 5-propynyluracil and 5-propynylcytosine.

In certain embodiments, antisense compounds targeted to a nrRNA comprise one or more modified nucleobases. In certain embodiments, gap-widened antisense oligonucleotides targeted to a nrRNA comprise one or more modified nucleobases. In certain embodiments, the modified nucleobase is 5-methylcytosine. In certain embodiments, each cytosine is a 5-methylcytosine.

Compositions and Methods for Formulating Pharmaceutical Compositions

Antisense oligonucleotides can be admixed with pharmaceutically acceptable active or inert substance for the preparation of pharmaceutical compositions or formulations. Compositions and methods for the formulation of pharmaceutical compositions are dependent upon a number of criteria, including, but not limited to, route of administration, extent of disease, or dose to be administered.

Antisense compound targeted to a nrRNA can be utilized in pharmaceutical compositions by combining the antisense compound with a suitable pharmaceutically acceptable diluent or carrier. A pharmaceutically acceptable diluent includes phosphate-buffered saline (PBS). PBS is a diluent suitable for use in compositions to be delivered parenterally. Accordingly, in one embodiment, employed in the methods described herein is a pharmaceutical composition comprising an antisense compound targeted to a nrRNA and a pharmaceutically acceptable diluent. In certain embodiments, the pharmaceutically acceptable diluent is PBS. In certain embodiments, the antisense compound is an antisense oligonucleotide.

Pharmaceutical compositions comprising antisense compounds encompass any pharmaceutically acceptable salts, esters, or salts of such esters, or any other oligonucleotide which, upon administration to an animal, including a human, is capable of providing (directly or indirectly) the biologically active metabolite or residue thereof. Accordingly, for example, the disclosure is also drawn to pharmaceutically acceptable salts of antisense compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of an antisense compound which are cleaved by endogenous nucleases within the body, to form the active antisense compound.

Conjugated Antisense Compounds

Antisense compounds can be covalently linked to one or more moieties or conjugates which enhance the activity, cellular distribution or cellular uptake of the resulting antisense oligonucleotides. Typical conjugate groups include cholesterol moieties and lipid moieties. Additional conjugate groups include carbohydrates, phospholipids, biotin, phenazine, folate, phenanthridine, anthraquinone, acridine, fluoresceins, rhodamines, coumarins, and dyes.

Antisense compounds can also be modified to have one or more stabilizing groups that are generally attached to one or both termini of antisense compounds to enhance properties such as, for example, nuclease stability. Included in stabilizing groups are cap structures. These terminal modifications protect the antisense compound having terminal nucleic acid from exonuclease degradation, and can help in delivery and/or localization within a cell. The cap can be present at the 5'-terminus (5'-cap), or at the 3'-terminus (3'-cap), or can be present on both termini. Cap structures are well known in the art and include, for example, inverted deoxy abasic caps. Further 3' and 5'-stabilizing groups that can be used to cap one or both ends of an antisense compound to impart nuclease stability include those disclosed in WO 03/004602 published on Jan. 16, 2003.

Cell Culture and Antisense Compounds Treatment

The effects of antisense compounds on the level or activity of a nrRNA can be tested in vitro in a variety of cell types. Cell types used for such analyses are available from commercial vendors (e.g. American Type Culture Collection, Manassas, Va.; Zen-Bio, Inc., Research Triangle Park, N.C.; Clonetics Corporation, Walkersville, Md.) and cells are cultured according to the vendor's instructions using commercially available reagents (e.g. Invitrogen Life Technologies, Carlsbad, Calif.). Illustrative cell types include, but are not limited to, HepG2 cells, Hep3B cells, primary hepatocytes, A549 cells, GM04281 fibroblasts and LLC-MK2 cells.

In Vitro Testing of Antisense Oligonucleotides

Described herein are methods for treatment of cells with antisense oligonucleotides, which can be modified appropriately for treatment with other antisense compounds.

In general, cells are treated with antisense oligonucleotides when the cells reach approximately 60-80% confluence in culture.

One reagent commonly used to introduce antisense oligonucleotides into cultured cells includes the cationic lipid transfection reagent LIPOFECTIN® (Invitrogen, Carlsbad, Calif.). Antisense oligonucleotides are mixed with LIPOFECTIN® in OPTI-MEM® 1 (Invitrogen, Carlsbad, Calif.) to achieve the desired final concentration of antisense oligonucleotide and a LIPOFECTIN® concentration that typically ranges 2 to 12 ug/mL per 100 nM antisense oligonucleotide.

Another reagent used to introduce antisense oligonucleotides into cultured cells includes LIPOFECTAMINE 2000® (Invitrogen, Carlsbad, Calif.). Antisense oligonucleotide is mixed with LIPOFECTAMINE 2000® in OPTI-MEM® 1 reduced serum medium (Invitrogen, Carlsbad, Calif.) to achieve the desired concentration of antisense oligonucleotide and a LIPOFECTAMINE® concentration that typically ranges 2 to 12 ug/mL per 100 nM antisense oligonucleotide.

Another reagent used to introduce antisense oligonucleotides into cultured cells includes Cytofectin® (Invitrogen, Carlsbad, Calif.). Antisense oligonucleotide is mixed with Cytofectin® in OPTI-MEM® 1 reduced serum medium (Invitrogen, Carlsbad, Calif.) to achieve the desired concentration of antisense oligonucleotide and a Cytofectin® concentration that typically ranges 2 to 12 ug/mL per 100 nM antisense oligonucleotide.

Another technique used to introduce antisense oligonucleotides into cultured cells includes electroporation.

Cells are treated with antisense oligonucleotides by routine methods. Cells are typically harvested 16-24 hours after antisense oligonucleotide treatment, at which time RNA or protein levels of target nucleic acids are measured by methods known in the art and described herein. In general, when treatments are performed in multiple replicates, the data are presented as the average of the replicate treatments.

The concentration of antisense oligonucleotide used varies from cell line to cell line. Methods to determine the optimal antisense oligonucleotide concentration for a particular cell line are well known in the art. Antisense oligonucleotides are typically used at concentrations ranging from 1 nM to 300 nM when transfected with LIPOFECTAMINE2000®, Lipofectin or Cytofectin. Antisense oligonucleotides are used at higher concentrations ranging from 625 to 20,000 nM when transfected using electroporation.

RNA Isolation

RNA analysis can be performed on total cellular RNA or poly(A)+ mRNA. Methods of RNA isolation are well known in the art. RNA is prepared using methods well known in the art, for example, using the TRIZOL® Reagent (Invitrogen, Carlsbad, Calif.) according to the manufacturer's recommended protocols.

Analysis of Inhibition of Target Levels or Expression

Inhibition of levels or activity of a nrRNA can be assayed in a variety of ways known in the art. For example, target nucleic acid levels can be quantitated by, e.g., Northern blot analysis, competitive polymerase chain reaction (PCR), or quantitative real-time PCR. RNA analysis can be performed on total cellular RNA or poly(A)+ mRNA. Methods of RNA isolation are well known in the art. Northern blot analysis is also routine in the art. Quantitative real-time PCR can be conveniently accomplished using the commercially available ABI PRISM® 7600, 7700, or 7900 Sequence Detection System, available from PE-Applied Biosystems, Foster City, Calif. and used according to manufacturer's instructions.

Quantitative Real-Time PCR Analysis of Target RNA Levels

Quantitation of target RNA levels can be accomplished by quantitative real-time PCR using the ABI PRISM® 7600, 7700, or 7900 Sequence Detection System (PE-Applied Biosystems, Foster City, Calif.) according to manufacturer's instructions. Methods of quantitative real-time PCR are well known in the art.

Prior to real-time PCR, the isolated RNA is animaled to a reverse transcriptase (RT) reaction, which produces complementary DNA (cDNA) that is then used as the substrate for the real-time PCR amplification. The RT and real-time PCR reactions are performed sequentially in the same sample well. RT and real-time PCR reagents are obtained from Invitrogen (Carlsbad, Calif.). RT, real-time-PCR reactions are carried out by methods well known to those skilled in the art.

Gene (or RNA) target quantities obtained by real time PCR are normalized using either the expression level of a gene whose expression is constant, such as cyclophilin A, or by quantifying total RNA using RIBOGREEN® (Invitrogen, Inc. Carlsbad, Calif.). Cyclophilin A expression is quantified by real time PCR, by being run simultaneously with the target, multiplexing, or separately. Total RNA is quantified using RIBOGREEN® RNA quantification reagent (Invitrogen, Inc. Eugene, Oreg.). Methods of RNA quantification by RIBOGREEN® are taught in Jones, L. J., et al, (Analytical Biochemistry, 1998, 265, 368-374). A CYTOFLUOR® 4000 instrument (PE Applied Biosystems) is used to measure RIBOGREEN® fluorescence.

Probes and primers are designed to hybridize to a nrRNA sequence. Methods for designing real-time PCR probes and primers are well known in the art, and can include the use of software such as PRIMER EXPRESS® Software (Applied Biosystems, Foster City, Calif.).

For Quantitation of nuclear structures, such as nuclear foci, speckles, paraspeckles and other nuclear substructures, induced by ncRNA as measure of antisense effects, immunofluorescence can be used (see e.g, Example 26). In situ hybridization can also be used to measure RNA.

Analysis of Protein Levels

Antisense inhibition of certain nrRNAs can be assessed by measuring associated protein levels. Protein levels can be evaluated or quantitated in a variety of ways well known in the art, such as immunoprecipitation, Western blot analysis (immunoblotting), enzyme-linked immunosorbant assay (ELISA), quantitative protein assays, protein activity assays (for example, caspase activity assays), immunohistochemistry, immunocytochemistry or fluorescence-activated cell sorting (FACS). Antibodies directed to a target can be identified and obtained from a variety of sources, such as the MSRS catalog of antibodies (Aerie Corporation, Birmingham, Mich.), or can be prepared via conventional monoclonal or polyclonal antibody generation methods well known in the art.

In Vivo Testing of Antisense Compounds

Antisense compounds, for example, antisense oligonucleotides, are tested in animals to assess their ability to inhibit a nrRNA and produce phenotypic changes. Testing can be performed in normal animals, or in experimental disease models. For administration to animals, antisense oligonucleotides are formulated in a pharmaceutically acceptable diluent, such as phosphate-buffered saline. Administration includes parenteral routes of administration. Following a period of treatment with antisense oligonucleotides, RNA is isolated from tissue and changes in nrRNA levels or activity are measured. In certain embodiments, changes in associated protein levels are also measured.

Certain Indications

In certain embodiments, provided herein are methods of treating an individual comprising administering one or more pharmaceutical compositions as described herein. In certain embodiments, the individual has a disease or condition associated with a nuclear-retained RNA.

Accordingly, provided herein are methods for ameliorating a symptom associated with a disease or condition associated with a nuclear-retained RNA in an animal in need thereof. In certain embodiments, provided is a method for reducing the rate of onset of a symptom associated with a disease or condition associated with a nuclear-retained RNA. In certain embodiments, provided is a method for reducing the severity of a symptom associated with a disease or condition associated with a nuclear-retained RNA. In such embodiments, the methods comprise administering to an individual in need thereof a therapeutically effective amount of a compound targeted to a nrRNA.

In certain embodiments, administration of an antisense compound targeted to a nrRNA results in reduction of nrRNA levels by at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or at least about 99%, or a range defined by any two of these values.

In certain embodiments, pharmaceutical compositions comprising an antisense compound targeted to a nrRNA are used for the preparation of a medicament for treating a patient suffering or susceptible to a disease or condition associated with a nuclear-retained RNA.

Administration

In certain embodiments, the compounds and compositions as described herein are administered parenterally.

In certain embodiments, parenteral administration is by injection. The injection can be delivered with a syringe.

Certain Combination Therapies

In certain embodiments, a first agent comprising the modified oligonucleotide of the invention is co-administered with one or more secondary agents. In certain embodiments, such second agents are designed to treat the same a disease or condition associated with a nuclear-retained RNA as the first agent described herein. In certain embodiments, such second agents are designed to treat a different disease, disorder, or condition as the first agent described herein. In certain embodiments, such second agents are designed to treat an undesired side effect of one or more pharmaceutical compositions as described herein. In certain embodiments, second agents are co-administered with the first agent to treat an undesired effect of the first agent. In certain embodiments, second agents are co-administered with the first agent to produce a combinational effect. In certain embodiments, second agents are co-administered with the first agent to produce a synergistic effect.

In certain embodiments, a first agent and one or more second agents are administered at the same time. In certain embodiments, the first agent and one or more second agents are administered at different times. In certain embodiments, the first agent and one or more second agents are prepared together in a single pharmaceutical formulation. In certain embodiments, the first agent and one or more second agents are prepared separately.

EXAMPLES

Non-Limiting Disclosure and Incorporation by Reference

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

Example 1: Antisense Inhibition of Human MALAT1 in A549 Cells

Antisense oligonucleotides targeted to a metastasis-associated lung adenocarcinoma transcript 1 (MALAT1) nucleic acid, a non-coding nuclear-retained RNA transcript, were tested for their effect on MALAT1 RNA transcript in vitro. Cultured A549 cells at a density of 5,000 cells per well were transfected using Lipofectin reagent with 60 nM antisense oligonucleotide. After approximately 24 hours, RNA was isolated from the cells and MALAT1 RNA transcript levels were measured by quantitative real-time PCR. The human primer probe set RTS2736 (forward sequence AAAGCAAGGTCTCCCCACAAG, designated herein as SEQ ID NO: 89; reverse sequence TGAAGGGTCTGT-GCTAGATCAAAA, designated herein as SEQ ID NO: 90; probe sequence TGCCACATCGCCACCCCGTX, designated herein as SEQ ID NO: 91) was used to quantitated MALAT1 RNA. MALAT1 RNA transcript levels were adjusted according to total RNA content, as measured by RIBOGREEN®. Results are presented as percent inhibition of MALAT1, relative to untreated control cells.

The antisense oligonucleotides in Table 3 are 5-10-5 gapmers, where the gap segment comprises ten 2'-deoxynucleosides and each wing segment comprises five 2'-MOE nucleosides. Each nucleotide in the 5' wing segment and each nucleotide in the 3' wing segment has a 2'-MOE modification. The internucleoside linkages throughout each gapmer are phosphorothioate (P=S) linkages. All cytidine residues throughout each gapmer are 5-methylcytidines. 'Target start site' indicates the 5'-most nucleotide to which the antisense oligonucleotide is targeted. 'Target stop site' indicates the 3'-most nucleotide to which the antisense oligonucleotide is targeted. All the antisense oligonucleotides listed in Table 3 target SEQ ID NO: 1 (GENBANK Accession No. EF177381).

Example 2: Antisense Inhibition of Human MALAT1 in A549 Cells

Antisense oligonucleotides targeted to a MALAT1 nucleic acid were tested for their effects on MALAT1 RNA in vitro. Cultured A549 cells at a density of 5,000 cells per well were transfected using Lipofectin reagent with 150 nM antisense oligonucleotide. After approximately 24 hours, RNA was isolated from the cells and MALAT1 RNA transcript levels were measured by quantitative real-time PCR. Human primer probe set RTS2736 was used to quantitate MALAT1 RNA. MALAT1 RNA transcript levels were adjusted according to total RNA content, as measured by RIBOGREEN®. Results are presented as percent inhibition of MALAT1, relative to untreated control cells.

The antisense oligonucleotides in Table 4 are 5-10-5 gapmers, where the gap segment comprises ten 2'-deoxynucleosides and each wing segment comprises five 2'-MOE nucleosides. Each nucleotide in the 5' wing segment and each nucleotide in the 3' wing segment has a 2'-MOE modification. The internucleoside linkages throughout each gapmer are phosphorothioate (P=S) linkages. All cytidine residues throughout each gapmer are 5-methylcytidines. 'Target start site' indicates the 5'-most nucleotide to which the antisense oligonucleotide is targeted. 'Target stop site' indicates the 3'-most nucleotide to which the antisense oligonucleotide is targeted. All the antisense oligonucleotides listed in Table 4 target SEQ ID NO: 1 (GENBANK Accession No. EF177381).

TABLE 3

Inhibition of human MALAT1 RNA transcript in A549 cells by 5-10-5 gapmers targeting SEQ ID NO: 1

| Target Start Site | Target Stop Site | ISIS No. | Sequence (5' to 3') | % inhibition | SEQ ID NO |
|---|---|---|---|---|---|
| 3520 | 3539 | 395240 | TGCCTTTAGGATTCTAGACA | 88 | 92 |
| 4085 | 4104 | 395243 | TAATTGCCAATATTTGCCCC | 82 | 93 |
| 4236 | 4255 | 395244 | GGGAGTTACTTGCCAACTTG | 89 | 94 |
| 4692 | 4711 | 395248 | TTGCAGTTAAACAATGGAAA | 84 | 95 |
| 4897 | 4916 | 395251 | CCAGGCTGGTTATGACTCAG | 89 | 96 |
| 4947 | 4966 | 395252 | TTATCAATTCACCAAGGAGC | 88 | 97 |
| 4982 | 5001 | 395253 | ATGGAGGTATGACATATAAT | 90 | 98 |
| 5042 | 5061 | 395254 | GGCATATGCAGATAATGTTC | 87 | 99 |
| 5322 | 5341 | 395255 | ACATTGGCACACAGCACAGC | 86 | 100 |
| 5333 | 5352 | 395256 | AGGCAAACGAAACATTGGCA | 90 | 101 |
| 5447 | 5466 | 395257 | CTAACATGCAATACTGCAGA | 88 | 102 |
| 5592 | 5611 | 395259 | AAGCCCACAGGAACAAGTCC | 84 | 103 |
| 6297 | 6316 | 395267 | GGTCAATAGTGTAAAACATT | 87 | 104 |
| 6373 | 6392 | 395269 | TTCATGAAGGATGAAATGCC | 84 | 105 |
| 6644 | 6663 | 395272 | CAATGCATTCTAATAGCAGC | 85 | 106 |
| 6958 | 6977 | 395275 | AACATTTCCACTTGCCAGTT | 87 | 107 |
| 7157 | 7176 | 395280 | GGTTCCCAATCCCCACATTT | 89 | 108 |
| 7534 | 7553 | 395283 | TAATAAAAATCAGGTGAGGC | 85 | 109 |
| 8077 | 8096 | 395287 | TCCCACCCAGCATTACAGTT | 84 | 110 |

TABLE 4

Inhibition of human MALAT1 RNA transcript in A549 cells by 5-10-5 gapmers targeting SEQ ID NO: 1

| Target Start Site | Target Stop Site | ISIS No. | Sequence (5' to 3') | % inhibition | SEQ ID NO |
|---|---|---|---|---|---|
| 3520 | 3539 | 395240 | TGCCTTTAGGATTCTAGACA | 87 | 92 |
| 4085 | 4104 | 395243 | TAATTGCCAATATTTGCCCC | 88 | 93 |
| 4236 | 4255 | 395244 | GGGAGTTACTTGCCAACTTG | 88 | 94 |
| 4692 | 4711 | 395248 | TTGCAGTTAAACAATGGAAA | 85 | 95 |
| 4897 | 4916 | 395251 | CCAGGCTGGTTATGACTCAG | 85 | 96 |
| 4947 | 4966 | 395252 | TTATCAATTCACCAAGGAGC | 92 | 97 |
| 4982 | 5001 | 395253 | ATGGAGGTATGACATATAAT | 93 | 98 |
| 5042 | 5061 | 395254 | GGCATATGCAGATAATGTTC | 75 | 99 |
| 5322 | 5341 | 395255 | ACATTGGCACACAGCACAGC | 86 | 100 |
| 5333 | 5352 | 395256 | AGGCAAACGAAACATTGGCA | 95 | 101 |
| 5447 | 5466 | 395257 | CTAACATGCAATACTGCAGA | 81 | 102 |
| 5592 | 5611 | 395259 | AAGCCCACAGGAACAAGTCC | 86 | 103 |
| 6297 | 6316 | 395267 | GGTCAATAGTGTAAAACATT | 84 | 104 |
| 6373 | 6392 | 395269 | TTCATGAAGGATGAAATGCC | 86 | 105 |
| 6644 | 6663 | 395272 | CAATGCATTCTAATAGCAGC | 90 | 106 |
| 6958 | 6977 | 395275 | AACATTTCCACTTGCCAGTT | 85 | 107 |
| 7157 | 7176 | 395280 | GGTTCCCAATCCCCACATTT | 86 | 108 |
| 7534 | 7553 | 395283 | TAATAAAAATCAGGTGAGGC | 84 | 109 |
| 8077 | 8096 | 395287 | TCCCACCCAGCATTACAGTT | 91 | 110 |

Example 3: Dose-Dependent Antisense Inhibition of Human MALAT1 in A549 Cells

Several of the antisense oligonucleotides exhibiting in vitro inhibition of MALAT1 in A549 cells (see Example 2) were tested at various doses. Cells were plated at a density of 5,000 cells per well and transfected using Lipofectin reagent with 7.5 nM, 15 nM, 30 nM, and 60 nM concentrations of each antisense oligonucleotide. After approximately 16 hours, RNA was isolated from the cells and MALAT1 RNA transcript levels were measured by quantitative real-time PCR using primer probe set RTS2736 MALAT1 RNA transcript levels were normalized to total RNA content, as measured by RIBOGREEN®. Results are presented in Table 5 as percent inhibition of MALAT1, relative to untreated control cells.

TABLE 5

Dose-dependent antisense inhibition of human MALAT1 in A549 cells tested with primer probe set RTS2736

| ISIS No. | 7.5 nM | 15 nM | 30 nM | 60 nM | $IC_{50}$ (nM) |
|---|---|---|---|---|---|
| 395240 | 67 | 81 | 90 | 96 | 1.8 |
| 395243 | 31 | 54 | 80 | 93 | 13.1 |
| 395244 | 76 | 73 | 86 | 91 | 0.5 |
| 395248 | 43 | 70 | 87 | 93 | 8.1 |
| 395251 | 57 | 73 | 84 | 90 | 4.0 |
| 395252 | 48 | 69 | 88 | 91 | 6.9 |
| 395253 | 54 | 73 | 90 | 93 | 5.1 |
| 395254 | 67 | 74 | 82 | 75 | 0.1 |
| 395255 | 39 | 69 | 82 | 92 | 9.4 |
| 395256 | 58 | 81 | 88 | 92 | 3.4 |
| 395257 | 60 | 78 | 89 | 93 | 3.3 |
| 395259 | 26 | 59 | 74 | 91 | 14.1 |
| 395267 | 36 | 64 | 79 | 88 | 10.6 |
| 395269 | 36 | 63 | 82 | 92 | 10.7 |
| 395272 | 55 | 65 | 82 | 91 | 6.0 |
| 395275 | 57 | 76. | 88 | 88 | 3.6 |
| 395280 | 68 | 82 | 87 | 86 | 0.6 |
| 395283 | 31 | 65 | 80 | 90 | 11.8 |
| 395287 | 21 | 74 | 78 | 87 | 12.7 |

To test whether the inhibition of MALAT1 by the various oligonucleotides was uniform across the MALAT1 transcript, the above dose-response experiment was repeated with two additional primer probe sets.

Probe set RTS 2738 has forward sequence of
SEQ ID NO: 111
GAATTGCGTCATTTAAAGCCTAGTT,;

reverse sequence of
SEQ ID NO: 112
TCATCCTACCACTCCCAATTAATCT,;
and a probe sequence of
SEQ ID NO: 113
ACGCATTTACTAAACGCAGACGAAAATGGAX,.

Probe set RTS 2739 has a forward sequence of
SEQ ID NO: 114
AGGCGTTGTGCGTAGAG GAT,;

a reverse sequence of
SEQ ID NO: 115
AAAGGTTACCATAAGTAAGTTCCAGAAAA,;
and a probe sequence of
SEQ ID NO: 116
AGTGGTTGGTAAAAATCCGTGAGGTCGGX,.

Results are presented in Tables 6 and 7 as percent inhibition of MALAT1, relative to untreated control cells.

TABLE 6

Dose-dependent antisense inhibition of human MALAT1 in A549 cells, primer probe set RTS2738

| ISIS No. | 7.5 nM | 15 nM | 30 nM | 60 nM | $IC_{50}$ (nM) |
|---|---|---|---|---|---|
| 395240 | 67 | 79 | 87 | 90 | 1.4 |
| 395243 | 29 | 55 | 76 | 90 | 13.9 |
| 395244 | 57 | 70 | 81 | 90 | 4.7 |
| 395248 | 35 | 64 | 84 | 89 | 10.6 |
| 395251 | 62 | 71 | 79 | 88 | 2.8 |
| 395252 | 46 | 66 | 84 | 89 | 7.6 |
| 395253 | 49 | 72 | 87 | 92 | 6.2 |
| 395254 | 61 | 75 | 79 | 84 | 2.0 |
| 395255 | 31 | 63 | 79 | 88 | 12.1 |
| 395256 | 55 | 78 | 85 | 89 | 4.0 |
| 395257 | 56 | 73 | 86 | 90 | 4.4 |
| 395259 | 18 | 58 | 75 | 86 | 15.9 |
| 395267 | 30 | 60 | 77 | 87 | 12.8 |
| 395269 | 28 | 53 | 81 | 90 | 13.9 |
| 395272 | 45 | 57 | 76 | 87 | 9.7 |
| 395275 | 52 | 71 | 83 | 85 | 5.2 |
| 395280 | 60 | 76 | 83 | 88 | 2.6 |
| 395283 | 23 | 51 | 72 | 84 | 16.4 |
| 395287 | 10 | 65 | 72 | 84 | 16.8 |

TABLE 7

Dose-dependent antisense inhibition of human MALAT1 in A549 cells, primer probe set RTS2739

| ISIS No. | 7.5 nM | 15 nM | 30 nM | 60 nM | $IC_{50}$ (nM) |
|---|---|---|---|---|---|
| 395240 | 69 | 81 | 89 | 93 | 1.2 |
| 395243 | 28 | 58 | 77 | 91 | 13.5 |
| 395244 | 59 | 72 | 85 | 91 | 4.0 |
| 395248 | 42 | 64 | 86 | 91 | 8.9 |
| 395251 | 65 | 74 | 83 | 91 | 2.3 |
| 395252 | 51 | 72 | 87 | 91 | 5.8 |
| 395253 | 51 | 73 | 90 | 94 | 5.8 |
| 395254 | 66 | 74 | 82 | 88 | 1.6 |
| 395255 | 39 | 64 | 84 | 90 | 9.8 |

TABLE 7-continued

Dose-dependent antisense inhibition of human MALAT1 in A549 cells, primer probe set RTS2739

| ISIS No. | 7.5 nM | 15 nM | 30 nM | 60 nM | $IC_{50}$ (nM) |
|---|---|---|---|---|---|
| 395256 | 58 | 80 | 88 | 92 | 3.3 |
| 395257 | 58 | 75 | 91 | 93 | 4.0 |
| 395259 | 22 | 58 | 75 | 88 | 15.1 |
| 395267 | 43 | 64 | 78 | 90 | 9.1 |
| 395269 | 34 | 56 | 79 | 92 | 12.4 |
| 395272 | 50 | 60 | 78 | 90 | 8.0 |
| 395275 | 55 | 76 | 87 | 87 | 3.8 |
| 395280 | 60 | 80 | 85 | 91 | 2.8 |
| 395283 | 32 | 54 | 74 | 84 | 13.9 |
| 395287 | 16 | 73 | 73 | 86 | 14.4 |

Example 4: Dose-Dependent Antisense Inhibition of Human MALAT1 in HeLa Cells

Several antisense oligonucleotides exhibiting in vitro inhibition of MALAT1 were tested at various doses in HeLa cells. Cells were plated at a density of 5,000 cells per well and transfected using Lipofectin reagent with 4.7 nM, 9.4 nM, 18.8 nM, 37.8 nM, 75 nM, and 150 nM concentrations of each antisense oligonucleotide, as indicated in Tables 8 and 9. After a treatment period of approximately 16 hours, RNA was isolated from the cells and MALAT1 RNA transcript levels were measured by quantitative real-time PCR. Human MALAT1 primer probe set RTS2736 and RTS2738 (see Example 3) were used to measure RNA transcript levels. MALAT1 RNA transcript levels were adjusted according to total RNA content, as measured by RIBOGREEN®. Results are presented as percent inhibition of MALAT1, relative to untreated control cells. As illustrated in Tables 8 and 9, MALAT1 RNA transcript levels were reduced in a dose-dependent manner.

TABLE 8

Dose-dependent antisense inhibition of human MALAT1 in HeLa cell line, primer probe set RTS2736

| ISIS No | 4.7 nM | 9.4 nM | 18.8 nM | 37.8 nM | 75 nM | 150 nM | $IC_{50}$ (nM) |
|---|---|---|---|---|---|---|---|
| 395240 | 25 | 36 | 54 | 68 | 85 | 95 | 16.2 |
| 395254 | 0 | 25 | 26 | 46 | 64 | 75 | 44.1 |
| 395280 | 6 | 2 | 41 | 63 | 84 | 91 | 28.7 |

TABLE 9

Dose-dependent antisense inhibition of human MALAT1 in HeLa cell line, primer probe set RTS2738

| ISIS No. | 4.7 nM | 9.4 nM | 18.8 nM | 37.8 nM | 75 nM | 150 nM | $IC_{50}$ (nM) |
|---|---|---|---|---|---|---|---|
| 395240 | 34 | 45 | 60 | 68 | 83 | 95 | 11.9 |
| 395254 | 0 | 18 | 19 | 50 | 76 | 93 | 34.7 |
| 395280 | 8 | 3 | 32 | 56 | 79 | 90 | 32.3 |

Example 5: Dose-Dependent Antisense Inhibition of Human MALAT1 in HeLa Cells

Several antisense oligonucleotides exhibiting in vitro inhibition of MALAT1 were tested at various doses in HeLa cells. Cells were plated at a density of 4,000 cells per well and transfected using Lipofectin reagent with 3.7 nM, 11.1 nM, 33.3 nM, and 100.0 nM concentrations of each antisense oligonucleotide. After a treatment period of 16 hours, RNA was isolated from the cells and MALAT1 RNA transcript levels were measured by quantitative real-time PCR. MALAT1 RNA transcript levels were adjusted according to total RNA content, as measured by RIBOGREEN®. Results are presented as percent inhibition of MALAT1, relative to untreated control cells. As illustrated in Table 10, MALAT1 RNA transcript levels were reduced in a dose-dependent manner.

TABLE 10

Dose-dependent antisense inhibition of human MALAT1 in HeLa cells

| ISIS No. | 3.7 nM | 11.1 nM | 33.3 nM | 100 nM | $IC_{50}$ (nM) |
| --- | --- | --- | --- | --- | --- |
| 395240 | 68 | 87 | 95 | 98 | 0.3 |
| 395280 | 59 | 86 | 97 | 97 | 0.9 |
| 395254 | 68 | 89 | 88 | 86 | 0.02 |
| 395244 | 57 | 84 | 97 | 98 | 1.2 |
| 395256 | 56 | 85 | 97 | 97 | 1.2 |
| 395275 | 34 | 64 | 91 | 98 | 6.5 |

Example 6: Dose-Dependent Antisense Inhibition of Human MALAT1 in U87MG Cells Several antisense oligonucleotides exhibiting in vitro inhibition of MALAT1 were tested at various doses in U87MG cells. Cells were plated at a density of 4,000 cells per well and transfected using Lipofectin reagent with 3.7 nM, 11.1 nM, 33.3 nM, and 100 nM concentrations of each antisense oligonucleotide. After a treatment period of 16 hours, RNA was isolated from the cells and MALAT1 RNA transcript levels were measured by quantitative real-time PCR. MALAT1 RNA transcript levels were adjusted according to total RNA content, as measured by RIBOGREEN®. Results are presented as percent inhibition of MALAT1, relative to untreated control cells. As illustrated in Table 11, MALAT1 RNA transcript levels were reduced in a dose-dependent manner.

TABLE 11

Dose-dependent antisense inhibition of human MALAT1 in U87MG cells

| ISIS No. | 3.7 nM | 11.1 nM | 33.3 nM | 100 nM | $IC_{50}$ (nM) |
| --- | --- | --- | --- | --- | --- |
| 395240 | 24 | 52 | 74 | 90 | 11.7 |
| 395280 | 25 | 48 | 77 | 83 | 12.3 |
| 395254 | 9 | 39 | 67 | 71 | 23.0 |
| 395244 | 18 | 45 | 78 | 87 | 14.0 |
| 395256 | 23 | 45 | 83 | 86 | 12.3 |
| 395275 | 3 | 45 | 73 | 89 | 17.5 |

Example 7: Dose-Dependent Antisense Inhibition of Human MALAT1 in HeLa Cells by siRNAs Several siRNAs specific for human MALAT1 RNA transcript were tested at various doses in the HeLa cell line. Cells were plated at a density of 5,000 cells per well and transfected using LipofectAMINE2000® reagent with 0.78 nM, 1.56 nM, 3.13 nM, 6.25 nM, 12.5 nM, 25 nM, 50 nM, 100 nM concentrations of each siRNA. After incubation for approximately 4 hours, transfection media was discarded, fresh media added, and the cells were further incubated for 18 hours. RNA was isolated from the cells and MALAT1 RNA transcript levels were measured by quantitative real-time PCR. Primer probe set RTS2739 was used to measure RNA transcript levels. Table 12 presents the results of inhibition compared to untreated control cells.

TABLE 12 siRNA inhibition of human MALAT1 RNA transcript compared to control

| | 0.78 nM | 1.56 nM | 3.13 nM | 6.25 nM | 12.5 nM | 25 nM | 50 nM | 100 nM | $IC_{50}$ (nM) |
| --- | --- | --- | --- | --- | --- | --- | --- | --- | --- |
| MALAT-1 | 38 | 14 | 0 | 19 | 40 | 44 | 44 | 55 | 109.8 |
| MALAT-2 | 18 | 21 | 45 | 51 | 62 | 73 | 76 | 70 | n.d. |
| MALAT-3 | 0 | 0 | 0 | 9 | 23 | 17 | 25 | 22 | n.d. |
| MALAT-4 | 0 | 8 | 10 | 19 | 40 | 38 | 49 | 39 | 103.4 | n.d. = no data

Example 8: Dose Response Studies with Antisense Oligonucleotides and Correlation with RNA Stability in b.END Cells The correlation of non-coding RNA stability of the murine nuclear-retained target molecule, MALAT1, to the dose of antisense oligonucleotide required to achieve target knockdown was studied.

Antisense oligonucleotides, ISIS 395251 (CCAGGCTG-GTTATGACTCAG; target site 3338), incorporated herein as SEQ ID NO: 96; ISIS 399462 (GGGTCAGCTGCCAAT-GCTAG, target site 1280), incorporated herein as SEQ ID NO: 117; ISIS 399479 (CGGTGCAAGGCTTAGGAATT, target site 4004), incorporated herein as SEQ ID NO: 118; ISIS 399488 (TTACCCTAGATGTTTAGCCA, target site 4621), incorporated herein as SEQ ID NO: 119; ISIS 399495 (GAAAATGGCATGTCTGCTTC, target site 120), incorporated herein as SEQ ID NO: 120; ISIS 399462 (GGGTCA-GCTGCCAATGCTAG, target site 1280), incorporated herein as SEQ ID NO: 117; ISIS 395290 (TAAGAT-GCTAGCTTGGCCAA, target site 6552), incorporated herein as SEQ ID NO: 121; ISIS 395275 (AACATTTC-CACTTGCCAGTT, target site 5348), incorporated herein as SEQ ID NO: 107; ISIS 399503 (AAATTGATGGC-CTTTTCTGG, target site 6316), incorporated herein as SEQ ID NO: 122; ISIS 399473 (ATATGCAGCTTTTCATCAGT, target site 3475), incorporated herein as SEQ ID NO: 123; and ISIS 399484 (ACAAGTACATTGGAGCACAT, target site 4206), incorporated herein as SEQ ID NO: 124; all targeting murine MALAT1 RNA transcript (GENBANK Accession No. 3144_097A, designated herein as SEQ ID NO: 125) were tested at various doses. b.END cells were plated at a density of 4,000 cells per well and transfected using Cytofectin reagent with 3.125 nM, 6.25 nM, 12.5 nM, 25 nM, 50 nM, and 100 nM concentrations of each antisense oligonucleotide. After approximately 16 hours, RNA was isolated from the cells and MALAT-1 RNA transcript levels were measured by quantitative real-time PCR using primer probe set mMALAT1#2 (forward sequence TGGGTTAGA-GAAGGCGTGTACTG, designated herein as SEQ ID NO: 126; reverse sequence TCAGCGGCAACTGGGAAA, designated herein as SEQ ID NO: 127; and probe sequence CGTTGGCACGACACCTTCAGGGACTX, designated herein as SEQ ID NO: 128). MALAT1 RNA transcript levels were normalized to total RNA content, as measured by RIBOGREEN®. Results are presented in Table 13 as percent inhibition of MALAT1, relative to untreated control cells.

All the gapmers of Table 13 are 5-10-5 gapmers, where the gap segment comprises ten 2'-deoxynucleosides and each wing segment comprises five 2'-MOE nucleosides. The internucleoside linkages throughout each gapmer are phosphorothioate (P=S) linkages. All cytidine residues throughout each gapmer are 5-methylcytidines.

To measure the stability of the MALAT1 non-coding RNA, b.END cells were treated with 8 µg/mL of actinomycin D over a period of 10 hours. Another set of cells were treated with 75 µM 5,6-dichloro-1-β-D-ribofuranosyl-benzimidazole (DRB) for the same time period. Both RNA synthesis inhibitors gave similar results, as presented in Table 14. Table 14 presents the percent mRNA levels compared to the PBS control after treatment with actinomycin D or DRB at different time points. The data demonstrates that the MALAT1 RNA does not get degraded and is therefore stable for the period of treatment.

The data from Tables 13 and 14 demonstrates that the $IC_{50}$ for oligonucleotides targeting RNA transcripts which are stable is low, suggesting that these RNA transcripts are more amenable for targeting compared to RNA transcripts which are not as stable. Therefore, these antisense oligonucleotides will be useful to employ in cases where oligonucleotide uptake by cells is low.

TABLE 13

Dose-dependent antisense inhibition of nuclear-retained RNA in b.END cells

| ISIS No. | 3.125 nM | 6.25 nM | 12.5 nM | 25.0 nM | 50.0 nM | 100.0 nM | $IC_{50}$ (nM) |
|---|---|---|---|---|---|---|---|
| 399479 | 14 | 31 | 55 | 71 | 84 | 91 | 12.6 |
| 399484 | 10 | 35 | 48 | 69 | 86 | 91 | 13.5 |
| 399488 | 10 | 11 | 32 | 52 | 76 | 85 | 22.3 |
| 399495 | 10 | 35 | 46 | 65 | 83 | 90 | 14.5 |
| 399462 | 20 | 36 | 50 | 68 | 81 | 92 | 12.3 |
| 395290 | 16 | 31 | 48 | 66 | 84 | 89 | 13.7 |

TABLE 13-continued

Dose-dependent antisense inhibition of nuclear-retained RNA in b.END cells

| ISIS No. | 3.125 nM | 6.25 nM | 12.5 nM | 25.0 nM | 50.0 nM | 100.0 nM | $IC_{50}$ (nM) |
|---|---|---|---|---|---|---|---|
| 395251 | 23 | 45 | 57 | 66 | 85 | 90 | 10.1 |
| 395275 | 22 | 30 | 46 | 57 | 76 | 86 | 15.2 |
| 399503 | 21 | 28 | 31 | 52 | 78 | 81 | 19.1 |
| 399473 | 29 | 32 | 45 | 57 | 79 | 86 | 13.5 |

TABLE 14

RNA levels (% PBS control) of nuclear-retained RNA at various time-points after treatment with actinomycin D or DRB

| Time (hrs) | actinomycin | DRB |
|---|---|---|
| 0.00 | 108 | 125 |
| 0.25 | 124 | 106 |
| 0.50 | 161 | 126 |
| 0.75 | 160 | 107 |
| 1.00 | 147 | 131 |
| 2.00 | 136 | 138 |
| 3.00 | 163 | 133 |
| 4.00 | 151 | 139 |
| 5.00 | 167 | 134 |
| 6.00 | 137 | 131 |
| 7.00 | 135 | 105 |
| 8.00 | 155 | 116 |
| 9.00 | 143 | 113 |
| 10.00 | 131 | 118 |

Example 9: Dose Response Studies with Antisense Oligonucleotides and Correlation with Murine Target mRNA Stability in b.END Cells The correlation of mRNA stability of the murine target molecule to the dose of antisense oligonucleotide required to achieve target knockdown was studied.

Antisense oligonucleotides, ISIS 5, ISIS 6, ISIS 7, ISIS 8, ISIS 9, ISIS 10, ISIS 11, ISIS 12, ISIS 13, and ISIS 14 targeting 'Target 3' gene sequence were tested at various doses. b.END cells were plated at a density of 4,000 cells per well and transfected using Cytofectin reagent with 6.25 nM, 12.5 nM, 25 nM, 50 nM, 100 nM, and 200 nM concentrations of each antisense oligonucleotide. After approximately 16 hours, RNA was isolated from the cells and 'Target 3' RNA transcript levels were measured by quantitative real-time PCR. 'Target 3' RNA transcript levels were normalized to total RNA content, as measured by RIBOGREEN®. Results are presented in Table 15 as percent inhibition of 'Target 3', relative to untreated control cells.

Antisense oligonucleotides, ISIS F, ISIS G, ISIS H, ISIS I, ISIS J, ISIS K, ISIS L, ISIS M, ISIS N, and ISIS O targeting 'Target 4' mRNA were tested at various doses. b.END cells were plated at a density of 4,000 cells per well and transfected using Cytofectin reagent with 1.4063 nM, 2.8125 nM, 5.625 nM, 11.25 nM, 22.5 nM and 45 nM concentrations of each antisense oligonucleotide. After approximately 16 hours, RNA was isolated from the cells and 'Target 4' RNA transcript levels were measured by quantitative real-time PCR. 'Target 4' RNA transcript levels were normalized to total RNA content, as measured by RIBOGREEN®. Results are presented in Table 16 as percent inhibition of 'Target 4', relative to untreated control cells.

All the gapmers of Tables 15 and 16 are 5-10-5 gapmers, where the gap segment comprises ten 2'-deoxynucleosides and each wing segment comprises five 2'-MOE nucleosides. The internucleoside linkages throughout each gapmer are phosphorothioate (P=S) linkages. All cytidine residues throughout each gapmer are 5-methylcytidines.

The data presented in Tables 15 and 16 demonstrate that the $IC_{50}$ for antisense oligonucleotides targeting 'Target 4' is about twenty times lower than the $IC_{50}$ for antisense oligonucleotides targeting 'Target 3' in the same cell line and for gapmers with similar motif.

To measure the stability of the target mRNAs, b.END cells were treated with 8 μg/mL of actinomycin D over a period of 9 hours. Another set of cells were treated with 75 μM 5,6-dichloro-1-β-D-ribofuranosyl-benzimidazole (DRB) for the same time period. Both RNA synthesis inhibitors gave similar results, as presented in Tables 17 and 18. Tables 17 and 18 present the percent mRNA levels compared to the PBS control after treatment with actinomycin D or DRB at different time points. The data demonstrates that 'Target 3' mRNA has significantly less stability than 'Target 4' mRNA.

The data from Tables 15-18 suggests that antisense inhibition of target mRNAs, which are comparatively more stable, is easier to achieve than antisense inhibition of target mRNAs with less stability.

TABLE 15

Dose-dependent antisense inhibition of 'Target 3' mRNA in b.END cells

|  | ISIS 5 | ISIS 6 | ISIS 7 | ISIS 8 | ISIS 9 | ISIS 10 | ISIS 11 | ISIS 12 | ISIS 13 | ISIS 14 |
|---|---|---|---|---|---|---|---|---|---|---|
| 6.25 nM | 13 | 18 | 25 | 24 | 0 | 0 | 15 | 2 | 18 | 21 |
| 12.5 nM | 31 | 24 | 8 | 8 | 0 | 19 | 21 | 22 | 22 | 27 |
| 25 nM | 24 | 32 | 12 | 18 | 6 | 28 | 25 | 4 | 30 | 33 |
| 50 nM | 43 | 43 | 39 | 24 | 40 | 43 | 53 | 36 | 58 | 42 |
| 100 nM | 40 | 82 | 53 | 39 | 74 | 51 | 86 | 62 | n.d. | n.d. |
| 200 nM | 57 | 71 | 24 | 73 | n.d. | 49 | n.d. | n.d. | n.d. | 54 |
| $IC_{50}$ (nM) | 147 | 46 | 1239 | 134 | 62 | 121 | 38 | 91 | 47 | 115 | n.d. = no data

TABLE 16

Dose-dependent antisense inhibition of 'Target 4' mRNA in b.END cells

|  | ISIS F | ISIS G | ISIS H | ISIS I | ISIS J | ISIS K | ISIS L | ISIS M | ISIS N | ISIS O |
|---|---|---|---|---|---|---|---|---|---|---|
| 1.4063 nM | 5 | 20 | 25 | 0 | 26 | 24 | 25 | 26 | 18 | 21 |
| 2.8125 nM | 32 | 37 | 32 | 21 | 46 | 46 | 43 | 36 | 28 | 17 |
| 5.625 nM | 67 | 56 | 61 | 50 | 68 | 69 | 60 | 62 | 50 | 34 |
| 11.25 nM | 91 | 87 | 87 | 82 | 88 | 92 | 92 | 78 | 77 | 69 |
| 22.5 nM | 98 | 96 | 96 | 92 | 93 | 98 | 98 | 94 | 90 | 86 |
| 45.0 nM | 98 | 99 | 96 | 90 | 93 | 97 | 95 | 93 | 94 | 89 |
| $IC_{50}$ (nM) | 4.6 | 4.2 | 4 | 6.6 | 3.1 | 3.1 | 3.4 | 4 | 5.4 | 7.1 |

TABLE 17 mRNA levels (% PBS control) of 'Target 3' at various time-points after treatment with actinomycin D or DRB

| Time (hrs) | actinomycin D | DRB |
|---|---|---|
| 0 | 100 | 100 |
| 0.15 | 81 | 97 |
| 0.3 | 73 | 62 |
| 0.45 | 77 | 39 |
| 1 | 38 | 41 |
| 1.15 | 28 | 18 |
| 1.3 | 20 | 13 |
| 1.45 | 11 | 7 |
| 2.45 | 4 | 5 |
| 3.45 | 2 | 11 |
| 4.45 | 3 | 15 |
| 5.45 | 2 | 31 |
| 6.45 | 2 | 36 |
| 7.45 | 2 | 44 |
| 8.45 | 3 | 50 |

TABLE 18 mRNA levels (% PBS control) of 'Target 4' at various time-points after treatment with actinomycin D or DRB

| Time (hrs) | actinomycin | DRB |
|---|---|---|
| 0.00 | 100 | 100 |
| 0.25 | 91 | 116 |
| 0.5 | 90 | 109 |
| 0.75 | 86 | 67 |
| 1.00 | 88 | 103 |
| 1.25 | 88 | 105 |

TABLE 18-continued mRNA levels (% PBS control) of 'Target 4' at various
time-points after treatment with actinomycin D or DRB

| Time (hrs) | actinomycin | DRB |
|---|---|---|
| 1.50 | 99 | 114 |
| 1.75 | 78 | 93 |
| 2.75 | 79 | 101 |
| 3.75 | 66 | 71 |
| 4.75 | 72 | 64 |
| 5.75 | 56 | 51 |
| 6.75 | 52 | 48 |
| 7.75 | 47 | 44 |
| 8.75 | 53 | 54 |

SR-B1 Stability

To measure the stability of the SR-B1 mRNA, b.END cells were treated with 8 µg/mL of actinomycin D over a period of 10 hours. Another set of cells were treated with 75 µM 5,6-dichloro-1-β-D-ribofuranosyl-benzimidazole (DRB) for the same time period. Both RNA synthesis inhibitors gave similar results, as presented in Table 19. Table 19 presents the percent mRNA levels compared to the PBS control after treatment with actinomycin D or DRB at different time points. The data demonstrates that SR-B1 mRNA does not get significantly degraded upto 10 hours of the treatment and is therefore stable for the period of treatment.

TABLE 19

RNA levels (% PBS control) of SR-B1 mRNA at various
time-points after treatment with actinomycin D or DRB

| Time (hrs) | actinomycin | DRB |
|---|---|---|
| 0.25 | 90 | 125 |
| 0.50 | 91 | 110 |
| 0.75 | 89 | 78 |
| 1.00 | 87 | 116 |
| 1.75 | 81 | 119 |
| 2.00 | 89 | 135 |
| 3.00 | 84 | 79 |
| 4.00 | 74 | 89 |
| 5.00 | 82 | 94 |
| 6.00 | 72 | 90 |
| 7.00 | 67 | 77 |
| 8.00 | 71 | 68 |
| 9.00 | 66 | 74 |
| 10.00 | 63 | 61 |

Example 10: Dose Response Studies with Antisense Oligonucleotides and Correlation with Target mRNA Stability in HUVEC Cells The correlation of mRNA stability of the human target molecule to the dose of antisense oligonucleotide required to achieve target knockdown was studied.

Antisense oligonucleotides, ISIS 1, ISIS 2, ISIS 3, and ISIS 4, targeting 'Target 1' mRNA were tested at various doses. HUVEC cells were plated at a density of 5,000 cells per well and transfected using LipoectAMINE2000® reagent with 0.0069 nM, 0.0206 nM, 0.0617 nM, 0.1852 nM, 0.5556 nM, 1.6667 nM, 5 nM and 15 nM concentrations of each antisense oligonucleotide. After approximately 16 hours, RNA was isolated from the cells and 'Target 1' RNA transcript levels were measured by quantitative real-time PCR. 'Target 1' RNA transcript levels were normalized to total RNA content, as measured by RIBOGREEN®. Results are presented in Table 20 as percent inhibition of 'Target 1', relative to untreated control cells.

Antisense oligonucleotides, ISISA, ISIS B, ISIS C, ISIS D, and ISIS E targeting 'Target 2' mRNA were tested at various doses. HUVEC cells were plated at a density of 5,000 cells per well and transfected using LipoectAMINE2000® reagent with 0.6173 nM, 1.8519 nM, 5.5556 nM, 16.6667 nM, 50 nM and 150 nM concentrations of each antisense oligonucleotide. After approximately 16 hours, RNA was isolated from the cells and 'Target 2' RNA transcript levels were measured by quantitative real-time PCR.

'Target 2' RNA transcript levels were normalized to total RNA content, as measured by RIBOGREEN®. Results are presented in Table 21 as percent inhibition of 'Target 2', relative to untreated control cells.

All the gapmers of Tables 20 and 21 are 2-13-5 gapmers, where the gap segment comprises thirteen 2'-deoxynucleosides and the 5' wing segment comprises two 2'-MOE nucleosides and the 3' wing segment comprises five 2'-MOE nucleosides. The internucleoside linkages throughout each gapmer are phosphorothioate (P=S) linkages. All cytidine residues throughout each gapmer are 5-methylcytidines.

The data presented in Tables 20 and 21 demonstrate that the $IC_{50}$ for antisense oligonucleotides targeting 'Target 1' is ten times lower than the $IC_{50}$ for antisense oligonucleotides targeting 'Target 2' in the same cell line and for gapmers with similar motif.

To measure the stability of the target mRNAs, HUVEC cells were treated with 8 µg/mL of actinomycin D over a period of 9 hours. Another set of cells were treated with 75 µM 5,6-dichloro-1-β-D-ribofuranosyl-benzimidazole (DRB) for the same time period. Another set of cells were 30 µg/mL of α-amanitin for the same time period. At time points indicated in Tables 21 and 22, mRNA was harvested and 'Target 1' or 'Target 2' mRNA levels were quantified by RT-PCR. All three RNA synthesis inhibitors gave similar results, as presented in Tables 22 and 23. Table 22 presents the percent mRNA levels compared to the PBS control after treatment with actinomycin D or DRB at different time points. Table 23 presents the percent mRNA levels compared to the PBS control after treatment with DRB and α-amanitin at different time points. Based on the results from the two different assays, the half-life of 'Target 2' mRNA is calculated to be within 2-4 hours. The half-life of 'Target 1' mRNA could not be calculated with the available data and is therefore beyond 9 hours. Therefore, the data in Tables 22 and 23 demonstrates that the 'Target 2' mRNA has significantly less stability than 'Target 1' mRNA.

The data from Tables 20-23 suggests that antisense inhibition of target mRNAs, which are comparatively more stable, is easier to achieve than antisense inhibition of target mRNAs with less stability.

TABLE 20

Dose-dependent antisense inhibition
of 'Target 1'mRNA in HUVEC cells

| | ISIS 1 | ISIS 2 | ISIS 3 | ISIS 4 |
|---|---|---|---|---|
| 0.0069 nM | 0 | 9 | 5 | 19 |
| 0.0206 nM | 14 | 26 | 26 | 45 |
| 0.0617 nM | 31 | 45 | 41 | 58 |
| 0.1852 nM | 56 | 59 | 58 | 76 |
| 0.5556 nM | 71 | 76 | 73 | 83 |
| 1.6667 nM | 79 | 84 | 84 | 89 |
| 5.0000 nM | 89 | 90 | 91 | 92 |

TABLE 20-continued

Dose-dependent antisense inhibition of 'Target 1' mRNA in HUVEC cells

|  | ISIS 1 | ISIS 2 | ISIS 3 | ISIS 4 |
|---|---|---|---|---|
| 15.000 nM | 92 | 91 | 90 | 93 |
| IC$_{50}$ (nM) | 0.24 | 0.13 | 0.15 | 0.04 |

TABLE 21

Dose-dependent antisense inhibition of 'Target 2' mRNA in HUVEC cells

|  | ISIS A | ISIS B | ISIS C | ISIS D | ISIS E |
|---|---|---|---|---|---|
| 0.6173 nM | 13 | 25 | 4 | 16 | 0 |
| 1.8519 nM | 16 | 12 | 19 | 22 | 21 |
| 5.5556 nM | 39 | 37 | 41 | 41 | 39 |
| 16.6667 nM | 60 | 61 | 62 | 70 | 60 |
| 50.000 nM | 71 | 75 | 68 | 78 | 71 |
| 150.000 nM | 76 | 71 | 71 | 79 | 72 |
| IC50 (nM) | 13.3 | 12.5 | 14.9 | 9.0 | 17.3 |

TABLE 22 mRNA levels (% PBS control) of 'Target 1' and 'Target 2' at various time-points after treatment with actinomycin D or DRB

| Time (hrs) | 'Target 1' actinomycin | 'Target 1' DRB | 'Target 2' actinomycin | 'Target 2' DRB |
|---|---|---|---|---|
| 0.00 | 100 | 100 | 100 | 100 |
| 0.25 | 92 | 82 | 106 | 131 |
| 0.5 | 102 | 90 | 101 | 106 |
| 0.75 | 88 | 98 | 99 | 108 |
| 1.00 | 82 | 105 | 86 | 72 |
| 1.25 | 102 | 91 | 65 | 86 |
| 1.5 | 98 | 92 | 65 | 59 |
| 1.75 | 90 | 119 | 85 | 61 |
| 2.75 | 98 | 98 | 60 | 37 |
| 3.75 | 101 | 98 | 43 | 41 |
| 4.75 | 99 | 108 | 39 | 19 |
| 5.75 | 92 | 113 | 23 | 9 |
| 6.75 | 85 | 108 | 19 | 9 |
| 7.75 | 85 | 82 | 20 | 11 |
| 8.75 | 98 | 100 | 10 | 6 |

TABLE 23 mRNA levels of 'Target 1' and 'Target 2' at various time-points after treatment with DRB or amanitin

| Time (hrs) | 'Target 1' DRB | 'Target 1' α-amanitin | 'Target 2' DRB | 'Target 2' α-amanitin |
|---|---|---|---|---|
| 0.00 | 100 | 100 | 100 | 100 |
| 0.50 | 100 | 112 | 77 | 109 |
| 0.75 | 100 | 113 | 59 | 107 |
| 1.00 | 107 | 118 | 55 | 117 |
| 1.25 | 110 | 118 | 33 | 111 |
| 1.50 | 99 | 113 | 37 | 118 |
| 2.00 | 105 | 121 | 31 | 118 |
| 3.00 | 113 | 116 | 19 | 61 |
| 4.00 | 103 | 117 | 11 | 34 |
| 5.00 | 106 | 113 | 8 | 25 |
| 6.00 | 101 | 114 | 8 | 13 |
| 7.00 | 93 | 115 | 8 | 14 |
| 8.00 | 92 | 109 | 11 | 12 |
| 9.00 | 94 | 107 | 13 | 10 |

Dose Response Studies with STAT3 Antisense Oligonucleotides and Correlation RNA Stability in HUVEC Cells The correlation of RNA stability of the non-nuclear-retained target molecule, STAT3, to the dose of antisense oligonucleotide required to achieve target knockdown was studied.

Antisense oligonucleotides, ISIS 337332 (GAAGCCCTTGCCAGCCATGT, designated herein as SEQ ID NO: 129), ISIS 345785 (TGCCTCCTCCTTGGGAATGT, designated herein as SEQ ID NO: 130), ISIS 455269 (GCTTAGATTCTCCTTAAACC, designated herein as SEQ ID NO: 131), ISIS 455271 (AAATGCTTAGATTCTCCTTA, designated herein as SEQ ID NO: 132), ISIS 455272 (TAAAATGCTTAGATTCTCCT, designated herein as SEQ ID NO: 133), ISIS 455291 (CAGCAGATCAAGTCCAGGGA, designated herein as SEQ ID NO: 134), ISIS 455370 (TAGGTGTTCCCATACGCACA, designated herein as SEQ ID NO: 135), ISIS 455371 (GCTAGGTGTTCCCATACGCA, designated herein as SEQ ID NO: 136), ISIS 455391 (TCAACTGTCTCCAGGCAGGA, designated herein as SEQ ID NO: 137), ISIS 455393 (CACATCAACTGTCTCCAGGC, designated herein as SEQ ID NO: 138), ISIS 455394 (GACACATCAACTGTCTCCAG, designated herein as SEQ ID NO: 139), ISIS 455411 (AACCCAATGGTAAGCCCAAG, designated herein as SEQ ID NO: 140), ISIS 455412 (TAAACCCAATGGTAAGCCCA, designated herein as SEQ ID NO: 141), ISIS 455471 (TGGAATTTGAATGCAGTGGC, designated herein as SEQ ID NO: 142), ISIS 455525 (GTACACACTATACACATTTT, designated herein as SEQ ID NO: 143), ISIS 455527 (GCCAAAAATTTACAACCCAT, designated herein as SEQ ID NO: 144), ISIS 455530 (AGAGACTAAAATCAAGGCTC, designated herein as SEQ ID NO: 145), ISIS 455536 (AGAACTGAAATTCCTTGGTC, designated herein as SEQ ID NO: 146), and 455540 (AAGTACTCTTTCAGTGGTTT, designated herein as SEQ ID NO: 147), all targeting human STAT3 RNA transcript (the complement of GENBANK Accession NT_010755.14 truncated from nucleobases 4185000 to 4264000, designated herein as SEQ ID NO: 148) were tested at various doses. HUVEC cells were plated at a density of 5,000 cells per well and transfected using Lipofectamine2000® reagent with 1.111 nM, 3.333 nM, 10 nM, and 30 nM concentrations of each antisense oligonucleotide. After approximately 16 hours, RNA was isolated from the cells and STAT3 RNA transcript levels were measured by quantitative real-time PCR. STAT3 RNA transcript levels were normalized to total RNA content, as measured by RIBOGREEN®. Results are presented in Table 24 as percent inhibition of STAT3, relative to untreated control cells.

All the gapmers of Table 24 are 5-10-5 gapmers, where the gap segment comprises ten 2'-deoxynucleosides and each wing segment comprises five 2'-MOE nucleosides. The internucleoside linkages throughout each gapmer are phosphorothioate (P=S) linkages. All cytidine residues throughout each gapmer are 5-methylcytidines.

To measure the stability of the STAT3 mRNA, HUVEC cells were treated with 8 μg/mL of actinomycin D over a period of 10 hours. Another set of cells were treated with 75 μM 5,6-dichloro-1-β-D-ribofuranosyl-benzimidazole (DRB) for the same time period. Both RNA synthesis inhibitors gave similar results, as presented in Table 25. Table 25 presents the percent mRNA levels compared to the PBS control after treatment with actinomycin D or DRB at different time points. The data demonstrates that STAT3 mRNA does not get degraded and is therefore stable for the period of treatment.

The data from Tables 24 and 25 demonstrates that the $IC_{50}$ for oligonucleotides targeting RNA transcripts which are stable is low, suggesting that these RNA transcripts are more amenable for targeting compared to RNA transcripts which are not as stable. Therefore, these antisense oligonucleotides will be useful to employ in cases where oligonucleotide uptake by cells is low.

TABLE 24

Dose-dependent inhibition of STAT3 mRNA in HUVEC cells

| ISIS No. | 30.0 nM | 10.0 nM | 3.3333 nM | 1.1111 nM | IC50 (nM) |
|---|---|---|---|---|---|
| 455540 | 87 | 65 | 28 | 8 | 6.5 |
| 455536 | 85 | 62 | 21 | 5 | 7.6 |
| 455530 | 83 | 62 | 26 | 11 | 7.1 |
| 455527 | 87 | 60 | 21 | 0 | 7.8 |
| 455525 | 72 | 42 | 9 | 0 | 13.4 |
| 455471 | 78 | 67 | 42 | 11 | 5.9 |
| 455371 | 90 | 73 | 46 | 15 | 4.5 |
| 455370 | 78 | 53 | 23 | 6 | 9.0 |
| 455393 | 81 | 62 | 33 | 6 | 7.0 |
| 455391 | 75 | 54 | 30 | 10 | 8.5 |
| 455394 | 85 | 63 | 33 | 5 | 6.7 |
| 455291 | 85 | 75 | 45 | 21 | 4.1 |
| 455271 | 86 | 71 | 40 | 16 | 4.9 |
| 455272 | 86 | 57 | 30 | 28 | 5.7 |
| 455269 | 84 | 72 | 49 | 23 | 4.0 |
| 455411 | 82 | 58 | 21 | 10 | 7.9 |
| 455412 | 79 | 50 | 27 | 15 | 8.4 |
| 345785 | 75 | 43 | 17 | 10 | 11.4 |
| 337332 | 80 | 49 | 12 | 0 | 10.5 |

TABLE 25

RNA levels (% PBS control) of STAT3 mRNA at various time-points after treatment with actinomycin D or DRB

| Time (hrs) | Actinomycin | DRB |
|---|---|---|
| 0.25 | 97 | 111 |
| 0.50 | 105 | 104 |
| 0.75 | 101 | 69 |
| 1.00 | 93 | 103 |
| 1.75 | 97 | 97 |
| 2.00 | 104 | 96 |
| 3.00 | 95 | 104 |
| 4.00 | 104 | 90 |
| 5.00 | 102 | 81 |
| 6.00 | 97 | 94 |
| 7.00 | 98 | 84 |
| 8.00 | 92 | 91 |
| 9.00 | 101 | 84 |
| 10.00 | 98 | 85 |

Example 11: Antisense Inhibition of Murine MALAT1 in BALB/c Mice

ISIS 395251 (CCAGGCTGGTTATGACTCAG; target site 3338), incorporated herein as SEQ ID NO: 96; ISIS 399462 (GGGTCAGCTGCCAATGCTAG, target site 1280), incorporated herein as SEQ ID NO: 117; ISIS 399479 (CGGTGCAAGGCTTAGGAATT, target site 4004), incorporated herein as SEQ ID NO: 118; and ISIS 399484 (ACAAGTACATTGGAGCACAT, target site 4206), incorporated herein as SEQ ID NO: 124; all targeting murine MALAT1 RNA transcript (GENBANK Accession No. 3144_097 A, designated herein as SEQ ID NO: 125) and which demonstrated statistically significant dose-dependent inhibition in vitro, were evaluated for their ability to reduce murine MALAT1 RNA transcript in vivo.

Treatment

Male BALB/c mice were maintained on a 12-hour light/dark cycle and fed ad libitum normal Purina mouse chow. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

The mice were divided into six treatment groups. The first four groups received intraperitoneal injections of ISIS 395251, ISIS 399462, ISIS 399479, or ISIS 399484 at a dose of 50 mg/kg twice per week for 3 weeks. The fifth group received intraperitoneal injections of control oligonucleotide ISIS 141923 at a dose of 50 mg/kg twice weekly for 3 weeks. The sixth group received intraperitoneal injections of saline twice weekly for 3 weeks. The saline-injected group served as the control group to which the oligonucleotide-treated group was compared.

Inhibition of MALAT1 RNA

Twenty four hours after the final dose, the animals were sacrificed and liver tissue was isolated. Liver RNA was isolated for real-time PCR analysis of MALAT1. As presented in Table 26, treatment with antisense oligonucleotides reduced MALAT1 RNA transcript expression. The results are expressed as percent inhibition of MALAT1 RNA transcript, relative to the PBS control. The control oligonucleotide, ISIS 141923, did not demonstrate significant inhibition of MALAT1 RNA, as expected.

TABLE 26

Percent inhibition of MALAT1 RNA transcript in BALB/c mice

| | % inhibition |
|---|---|
| ISIS 141923 | 20 |
| ISIS 395251 | 98 |
| ISIS 399484 | 97 |
| ISIS 399462 | 94 |
| ISIS 399479 | 96 |

Example 12: Dose-Dependent Antisense Inhibition of Murine MALAT1 RNA

ISIS 399462 and ISIS 399479, which showed statistically significant in vivo inhibition of MALAT1, were further evaluated in a dose response study.

Treatment

BALB/c mice were injected with 10 mg/kg, 20 mg/kg, or 40 mg/kg of ISIS 399462 or ISIS 399479 twice a week for 3 weeks. ISIS 141923 was injected in another group of mice at 50 mg/kg twice a week for 3 weeks. A control group of mice was injected with PBS twice a week for 3 weeks.

RNA Analysis

RNA was extracted from liver tissue for real-time PCR analysis of MALAT1. As shown in Table 27, the antisense oligonucleotides achieved dose-dependent reduction of murine MALAT1 over the PBS control. Results are presented as percent inhibition of MALAT1, relative to the PBS control. The control oligonucleotide, ISIS 141923, did not demonstrate significant inhibition of MALAT1 RNA, as expected.

TABLE 27

Dose-dependent inhibition of murine MALAT1 RNA transcript in BALB/c mice

|  | mg/kg | % inhibition |
|---|---|---|
| ISIS 141923 | 50 | 34 |
| ISIS 399462 | 10 | 89 |
|  | 20 | 95 |
|  | 40 | 97 |
| ISIS 399479 | 10 | 96 |
|  | 20 | 94 |
|  | 40 | 96 |

Example 13: Dose-Dependent Antisense Inhibition of MALAT1 RNA in Various Murine Tissues ISIS 399462, which showed statistically significant in vivo inhibition of MALAT1, was further evaluated in a dose response study.

Treatment

BALB/c mice were injected with 12.5 mg/kg, 25 mg/kg, or 50 mg/kg of ISIS 399462 twice a week for 3.5 weeks. A control group of mice was injected with PBS twice a week for 3.5 weeks.

RNA Analysis

RNA was extracted from liver, heart, tibialis anterior (TA), diaphragm, quadriceps, and gastrocnemius muscle tissues for real-time PCR analysis of MALAT1. As shown in Table 28, ISIS 399462 achieved dose-dependent reduction of murine MALAT1 in all tissues over the PBS control. Results are presented as percent inhibition of MALAT1, relative to the PBS control.

TABLE 28

Dose-dependent inhibition of murine MALAT1 RNA transcript in various murine tissues

|  | 12.5 mg/kg | 25 mg/kg | 50 mg/kg |
|---|---|---|---|
| Liver | 94 | 95 | 96 |
| Heart | 31 | 50 | 54 |
| TA | 61 | 74 | 80 |
| Diaphragm | 63 | 73 | 83 |
| Quadriceps | 64 | 84 | 85 |
| Gastrocnemius | 70 | 79 | 89 |

Example 17: Dose Response Studies of Antisense Oligonucleotides in MHT2W Tumor Cells Potency of antisense oligonucleotides in MHT2W cells was studied.

MHT2W cells were plated at a density of 4,500 cells per well in a 96-well plate. The cells were treated the next day with 0.02 μM, 0.1 μM, 0.5 μM, 2.5 μM, and 10 μM concentrations of ISIS 15 (5-10-5 MOE gapmer targeting SR-B1), ISIS 19 (5-10-5 MOE gapmer targeting MALAT-1), ISIS 20 (5-10-5 MOE gapmer targeting MALAT-1), ISIS 21 (3-10-3 (S)-cEt gapmer targeting STAT3), or ISIS 22 (5-10-5 MOE gapmer targeting STAT3). After approximately 16 hours, RNA was isolated from the cells and target mRNA transcript levels were measured by quantitative real-time PCR. Each target mRNA transcript levels were normalized to total RNA content, as measured by RIBOGREEN®. Results are presented in Table 29 as percent inhibition of SR-B1 or PTEN, relative to untreated control cells.

The 5-10-5 gapmers in Table 29 are oligonucleotides where the gap segment comprises ten 2'-deoxynucleosides and each wing segment comprises five 2'-MOE nucleosides. The internucleoside linkages throughout each gapmer are phosphorothioate (P=S) linkages. All cytidine residues throughout each gapmer are 5-methylcytidines. The 3-10-3 gapmers are oligonucleotides where the gap segment comprises ten 2'-deoxynucleosides and each wing segment comprises three deoxynucleosides linked to (S)-cEt sugars.

TABLE 29

Dose-dependent antisense inhibition of target mRNA in MHT2W tumor cells

| ISIS No | Target | Motif | 0.02 μM | 0.1 μM | 0.5 μM | 2.5 μM | 10 μM | $IC_{50}$ (μM) |
|---|---|---|---|---|---|---|---|---|
| 15 | SR-B1 | 5-10-5 MOE | 37 | 53 | 61 | 72 | 82 | 1.00 |
| 19 | MALAT-1 | 5-10-5 MOE | 16 | 47 | 63 | 62 | 72 | 0.40 |
| 20 | MALAT-1 | 5-10-5 MOE | 44 | 64 | 73 | 79 | 85 | 0.02 |
| 21 | STAT3 | 3-10-3 (S)-cEt | 9 | 8 | 25 | 42 | 61 | 5.24 |
| 22 | STAT3 | 5-10-5 MOE | 4 | 16 | 17 | 13 | 24 | >10 |

Example 18: Dose Response Studies of Antisense Oligonucleotides in Human Glioblastoma Tumor Cells Potency of antisense oligonucleotides in the human glioblastoma cell lines, SNB19 and U251, was studied.

SNB19 cells were plated at a density of 4,500 cells per well in a 96-well plate. The cells were treated the next day with 0.02 μM, 0.1 μM, 0.5 μM, 2.5 μM and 10 μM concentrations of ISIS 23 (5-10-5 MOE gapmer targeting STAT3), ISIS 21 (3-10-3 (S)-cEt gapmer targeting STAT3), ISIS 24 (5-10-5 MOE gapmer targeting STAT3), ISIS 20 (5-10-5 MOE gapmer targeting MALAT-1), or ISIS 25 (5-10-5 MOE gapmer targeting kinesin family member 11 or Eg5). After approximately 16 hours, RNA was isolated from the cells and target mRNA transcript levels were measured by quantitative real-time PCR. Each target mRNA transcript levels were normalized to total RNA content, as measured by RIBOGREEN®. Results are presented in Table 30 as percent inhibition of STAT3, MALAT-1 or Eg5, relative to untreated control cells.

U251 cells were plated at a density of 4,500 cells per well in a 96-well plate. The cells were treated the next day with 0.02 μM, 0.1 μM, 0.5 μM, 2.5 μM and 10 μM concentrations of ISIS 23 (5-10-5 MOE gapmer targeting STAT3), ISIS 21 (3-10-3 (S)-cEt gapmer targeting STAT3), ISIS 24 (5-10-5 MOE gapmer targeting STAT3), ISIS 20 (5-10-5 MOE gapmer targeting MALAT-1), or ISIS 25 (5-10-5 MOE gapmer targeting kinesin family member 11 or Eg5). After approximately 16 hours, RNA was isolated from the cells and target mRNA transcript levels were measured by quantitative real-time PCR. Each target mRNA transcript levels were normalized to total RNA content, as measured by RIBOGREEN®. Results are presented in Table 31 as percent inhibition of STAT3, MALAT-1 or Eg5, relative to untreated control cells.

The 5-10-5 gapmers in Tables 30 and 31 are oligonucleotides where the gap segment comprises ten 2'-deoxynucleosides and each wing segment comprises five 2'-MOE nucleosides. The internucleoside linkages throughout each gapmer are phosphorothioate (P=S) linkages. All cytidine residues throughout each gapmer are 5-methylcytidines. The 3-10-3 gapmers are oligonucleotides where the gap segment comprises ten 2'-deoxynucleosides and each wing segment comprises three deoxynucleosides linked to (S)-cEt sugars.

TABLE 30

Dose-dependent antisense inhibition of target mRNA in SNB19 glioblastoma cells

| ISIS No | Target | Motif | 0.02 µM | 0.1 µM | 0.5 µM | 2.5 µM | 10 µM | IC$_{50}$ (µM) |
|---|---|---|---|---|---|---|---|---|
| 20 | MALAT-1 | 5-10-5 MOE | 43 | 82 | 94 | 95 | 97 | 0.008 |
| 21 | STAT3 | 3-10-3 (S)-cEt | 1 | 34 | 55 | 81 | 92 | 0.4 |
| 23 | STAT3 | 5-10-5 MOE | 2 | 9 | 46 | 69 | 72 | 1.1 |
| 24 | STAT3 | 5-10-5 MOE | 24 | 43 | 51 | 79 | 91 | 0.2 |
| 25 | Eg5 | 5-10-5 MOE | 30 | 38 | 46 | 61 | 71 | 0.5 |

TABLE 31

Dose-dependent antisense inhibition of target mRNA in U251 glioblastoma cells

| ISIS No | Target | Motif | 0.02 µM | 0.1 µM | 0.5 µM | 2.5 µM | 10 µM | IC$_{50}$ (µM) |
|---|---|---|---|---|---|---|---|---|
| 20 | MALAT-1 | 5-10-5 MOE | 31 | 51 | 53 | 64 | 88 | 0.19 |
| 21 | STAT3 | 3-10-3 (S)-cEt | 1 | 1 | 4 | 27 | 52 | 2.8 |
| 23 | STAT3 | 5-10-5 MOE | 4 | 6 | 4 | 7 | 24 | >10 |
| 24 | STAT3 | 5-10-5 MOE | 0 | 0 | 0 | 28 | 31 | >10 |
| 25 | Eg5 | 5-10-5 MOE | 0 | 1 | 11 | 14 | 19 | >10 |

Example 19: In Vivo Studies with Antisense Oligonucleotides in MHT2W Xenograft Tumor Model In vivo uptake and potency of an antisense oligonucleotide targeting a nuclear-retained RNA was compared with that of antisense oligonucleotide targeting non-nuclear retained RNAs in a xenograft tumor model.

Treatment

MHT2W tumor cells (1×10$^6$, of human origin) were injected subcutaneously in female Balb/c nu/nu mice. After 4-7 days, ISIS 395251 (CCAGGCTGGTTATGACTCAG (SEQ ID NO: 96), targeting nuclear-retained RNA, MALAT1) or ISIS 383741 (GACTCTTGCAGGAATCG-GCT (SEQ ID NO: 149), targeting non-nuclear-retained RNA, Stat3) at a dose of 50 mg/kg was injected intraperitoneally two times per week for a total of 7 doses. The mice were euthanized one day after the last dose.

mRNA Analysis

RNA was isolated from the liver and tumor cells at the end of the study for real-time PCR analysis of MALAT1 and Stat3, and normalized to RIBOGREEN®. The results are presented in Table 32 expressed as percent inhibition of mRNA transcript, relative to the PBS control.

TABLE 32

Percent inhibition of mRNA transcript after antisense treatment in a xenograft tumor mouse model

| ISIS No. | Tumor | Liver |
|---|---|---|
| 395251 | 49 | 93 |
| 383741 | 27 | 93 |

Example 23: In Vivo Studies of Antisense Oligonucleotide Pharmacology in Mice Bone Marrow Cells In vivo uptake and potency of antisense oligonucleotides was studied in bone marrow cells of C57Bl/6 mice.

Treatment

Groups of mice were treated with ISIS 19 (5-10-5 MOE gapmer targeting MALAT-1), ISIS 23 (5-10-5 MOE gapmer targeting STAT3) or ISIS 15 (5-10-5 MOE gapmer targeting SR-B1) at a dose of 40 mg/kg injected intravenously daily for 4 days. A control group of mice was injected with PBS intravenously daily for 4 days. The mice were euthanized one day after the last dose. Bone marrow and liver tissue was collected from the mice. CD45$^+$ leukocytes were isolated from the bone marrow for analysis.

mRNA Analysis

RNA was isolated from the liver, bone marrow cells and bone marrow CD45$^+$leukocytes at the end of the study for real-time PCR analysis of MALAT-1, STAT3 and SR-B1, and normalized to RIBOGREEN®. Table 33 presents the percent inhibition of the murine RNA transcript, relative to the PBS control. The data demonstrates that antisense oligonucleotides targeting SR-B1 and STAT3, although potent in the liver, are not able to diffuse into tumor cells easily. Antisense oligonucleotides targeting a nuclear-retained target, MALAT-1, were able to diffuse into the bone marrow cells and cause potent inhibition of target RNA.

TABLE 33

Percent inhibition of RNA transcript after antisense treatment

| ISIS No | Target | Motif | Liver | Bone marrow | CD45$^+$ cells |
|---|---|---|---|---|---|
| 15 | SR-B1 | 5-10-5 MOE | 93 | 16 | 0 |
| 19 | MALAT-1 | 5-10-5 MOE | 95 | 53 | 49 |
| 23 | STAT3 | 5-10-5 MOE | 80 | 0 | 0 |

Example 24: Antisense Inhibition of Human Alpha1 Skeletal Actin in HepG2 Cells

Antisense oligonucleotides targeted to a human alpha1 skeletal actin nucleic acid were tested for their effect on alpha1 actin RNA transcript in vitro. Cultured HepG2 cells at a density of 20,000 cells per well were transfected using electroporation with 10,000 nM antisense oligonucleotide. After approximately 24 hours, RNA was isolated from the cells and alpha1 actin RNA transcript levels were measured by quantitative real-time PCR. Alpha1 actin RNA transcript levels were adjusted according to total RNA content, as measured by RIBOGREEN®. Results are presented as percent inhibition of alpha1 actin, relative to untreated control cells.

The antisense oligonucleotides in Table 34 are 5-10-5 gapmers, where the gap segment comprises ten 2'-deoxynucleosides and each wing segment comprises five 2'-MOE nucleosides. The internucleoside linkages throughout each gapmer are phosphorothioate (P=S) linkages. All cytidine residues throughout each gapmer are 5-methylcytidines. 'Target start site' indicates the 5'-most nucleotide to which the antisense oligonucleotide is targeted. 'Target stop site' indicates the 3'-most nucleotide to which the antisense oligonucleotide is targeted. All the antisense oligonucleotides listed in Table 34 target SEQ ID NO: XXX (GEN-BANK Accession No. NM_001100.3).

TABLE 34

Inhibition of human alpha1 actin RNA transcript in HepG2 cells by 5-10-5 gapmers targeting SEQ ID NO: 177

| Target Start Site | Target Stop Site | ISIS No. | Sequence (5' to 3') | % inhibition | SEQ ID NO |
|---|---|---|---|---|---|
| 16 | 35 | 445205 | AGCGAGGCTTCACTTGGCGC | 74 | 150 |
| 20 | 39 | 190403 | GGGAAGCGAGGCTTCACTTG | 75 | 151 |
| 1028 | 1047 | 190401 | GCGGTCAGCGATCCCAGGGT | 78 | 152 |
| 1058 | 1077 | 445225 | GGGTGCCAGCGCGGTGATCT | 73 | 153 |
| 1320 | 1339 | 445231 | TGTTACAAAGAAAGTGACTG | 74 | 154 |
| 1339 | 1358 | 445232 | CGATGGCAGCAACGGAAGTT | 96 | 155 |
| 1348 | 1367 | 445233 | GTCAGTTTACGATGGCAGCA | 100 | 156 |
| 1417 | 1436 | 445235 | CAGGGCTTTGTTTCGAAAAA | 91 | 157 |
| 1430 | 1449 | 445236 | CCATTTTCTTCCACAGGGCT | 99 | 158 |
| 1447 | 1466 | 445237 | ATGCTTCTTCAAGTTTTCCA | 97 | 159 |
| 1460 | 1479 | 445238 | CAGAATGACTTTAATGCTTC | 95 | 160 |

Example 25: Dose-Dependent Antisense Inhibition of Human Alpha1 Actin in HepG2 Cells Several of the antisense oligonucleotides exhibiting in vitro inhibition of alpha1 actin in HepG2 cells (see Example 26) were tested at various doses. Cells were plated at a density of 20,000 cells per well and transfected using electroporation with 625 nM, 1,250 nM, 2,500 nM, 5,000 nM, 10,000 nM and 20,000 nM concentrations of each antisense oligonucleotide. After approximately 16 hours, RNA was isolated from the cells and alpha1 actin RNA transcript levels were measured by quantitative real-time PCR using primer probe set RTS3154 (forward sequence CCACCGCAAATGCTTCTAGAC, designated herein as SEQ ID NO: 161; reverse sequence CCCCCCCATTGAGAAGATTC, designated herein as SEQ ID NO: 162; probe sequence CTCCACCTCCAGCACGCGACTTCTX, designated herein as SEQ ID NO: 163). Alpha1 actin RNA transcript levels were normalized to total RNA content, as measured by RIBOGREEN®. Results are presented in Table 35 as percent inhibition of alpha1 actin, relative to untreated control cells.

TABLE 35

Dose-dependent antisense inhibition of human alpha1 actin in HepG2 cells

| ISIS No. | 625.0 nM | 1250.0 nM | 2500.0 nM | 5000.0 nM | 10000.0 nM | 20000.0 nM | IC50 (mM) |
|---|---|---|---|---|---|---|---|
| 445233 | 21 | 72 | 63 | 82 | 96 | 83 | 1.1 |
| 445236 | 26 | 68 | 82 | 91 | 90 | 91 | 0.8 |
| 445237 | 36 | 59 | 76 | 84 | 83 | 90 | 0.8 |
| 445232 | 14 | 42 | 54 | 59 | 80 | 91 | 2.6 |
| 445238 | 27 | 43 | 54 | 73 | 76 | 90 | 2 |

TABLE 35-continued

Dose-dependent antisense inhibition of human alpha1 actin in HepG2 cells

| ISIS No. | 625.0 nM | 1250.0 nM | 2500.0 nM | 5000.0 nM | 10000.0 nM | 20000.0 nM | IC50 (mM) |
|---|---|---|---|---|---|---|---|
| 445235 | 26 | 52 | 29 | 58 | 59 | 24 | n.a. |
| 190403 | 25 | 29 | 36 | 25 | 61 | 54 | n.a. |
| 190401 | 17 | 14 | 40 | 68 | 76 | 72 | 3.9 |
| 445225 | 25 | 23 | 49 | 28 | 52 | 50 | n.a. |
| 445205 | 26 | 31 | 34 | 28 | 55 | 36 | n.a. |
| 445231 | 30 | 25 | 39 | 26 | 42 | 36 | n.a |

Example 26: In Vivo Antisense Inhibition of Human Alpha1 Actin in Transgenic Mice HSA (human skeletal actin)$^{LR}$ (long repeat) mice were generated by insertion in FVB/N mice of a transgene with 250 CTG repeats in the 3' UTR of human skeletal actin. The transgene is expressed in the mice as a CUG repeat RNA, which is retained in the nucleus, forming nuclear inclusions or foci, similar to that seen in human tissue samples of patients with myotonic dystrophy.

ISIS 190403, ISIS 445236 and ISIS 445238, which demonstrated statistically significant dose-dependent inhibition in vitro, were evaluated for their ability to reduce human alpha1 actin RNA transcript in vivo.

Treatment

HSA$^{LR}$ mice were maintained on a 12-hour light/dark cycle and fed ad libitum normal Purina mouse chow. Animals were acclimated for at least 7 days in the research facility before initiation of the experiment. Antisense oligonucleotides (ASOs) were prepared in PBS and sterilized by filtering through a 0.2 micron filter. Oligonucleotides were dissolved in 0.9% PBS for injection.

The mice were divided into four treatment groups. The first three groups received subcutaneous injections of ISIS 190403, ISIS 445236 or ISIS 445238 at a dose of 25 mg/kg twice per week for 4 weeks. The fourth group received subcutaneous injections of PBS twice weekly for 4 weeks. The PBS-injected group served as the control group to which the oligonucleotide-treated group was compared.

Inhibition of alpha1 Actin RNA

Twenty four hours after the final dose, the animals were sacrificed and tissue from the quadriceps muscles (left and right), gastrocnemius muscles (left and right), and tibialis anterior muscles (left and right) was isolated. RNA was isolated for real-time PCR analysis of alpha1 actin and normalized to 18s RNA. As presented in Table 36, treatment with antisense oligonucleotides reduced human alpha1 actin RNA transcript expression. The results are expressed as percent inhibition of alpha1 actin transcript, relative to the control.

TABLE 36

Percent inhibition of human alpha1 actin RNA transcript in HSA$^{LR}$ mice

| Muscle Type | ISIS 190403 | ISIS 445236 | ISIS 445238 |
|---|---|---|---|
| Quadriceps | 16 | 83 | 72 |
| Gastrocnemius | 0 | 85 | 73 |
| Tibialis anterior | 2 | 81 | 71 |

Fluorescence In Situ Hybridization of Alpha1 Actin in Muscles

Frozen muscle tissue sections were fixed in fresh 3% paraformaldehyde in PBS solution for 15-20 minutes, after which they were rinsed twice with PBS for 5 minutes. The nuclei were permeabilized with 0.5% Triton X-100 for 5 minutes after which the tissue was blocked with normal goat serum for 30 minutes. The sections were incubated a 2′-O-methyl RNA targeted to alpha1 actin that is 5′-labeled with Texas Red (Integrated DNA Technologies). The sections were counter-stained with DAPI to label the nuclei. The sections were mounted and viewed with a standard fluorescence microscope. Image acquisition was by Metavue software and deconvolution was achieved by Autoquant software.

All muscle tissue sections from mice treated with ISIS 445236 and ISIS 445238 displayed reduced fluorescent intensity of alpha1 actin signal at the ribonuclear foci, indicating antisense inhibition of human alpha1 actin mRNA and reduction of the RNA in the nuclear foci.

Assessment of Myotonia by Electromyography

Myotonia refers to repetitive action potential that is due to delayed relaxation of muscle fibers. This phenomenon is observed in patients of myotonic dystrophy as well as in the HSA$^{LR}$ mice. When the EMG needle is inserted into a myotonic muscle, the electrical activity is prolonged for up to several seconds past when the insertional activity should normally cease. The frequency of myotonic discharges ranges from 50 to 100 impulses per second.

Myotonia may be measured via electromyography and is graded in the following manner: grade 0 refers to no myotonia elicited by any needle insertion (0%); grade 1 refers to myotonia elicited by less than 50% needle insertions; grade 2 refers to myotonia elicited by more than 50% needle insertions; and grade 3 refers to myotonia elicited by 100% needle insertions.

Before electromyography, mice were anesthetized by using i.p. 100 mg_kg ketamine, 10 mg_kg xylazine, and 3 mg_kg acepromazine or 250 mg_kg 2,2,2 tribromoethanol. Electromyography on left and right quadriceps, left and right gastrocnemius muscles, left and right tibialis anterior muscles and lumbar paraspinals muscles was performed as previously described (Kanadia et al, 2003, Science, 302: 1978-1980) by using 30 gauge concentric needle electrodes and a minimum of 10 needle insertions for each muscle. The data is presented in Table 37 as the average myotonia grade observed in four mice of each group and demonstrates significant reduction of myotonia in mice treated with ISIS 445236 and ISIS 445238.

TABLE 37

Average reduction of myotonia in various muscles of antisense oligonucleotide-treated HSA$^{LR}$ mice

| | PBS | ISIS 190403 | ISIS 445236 | ISIS 445238 |
|---|---|---|---|---|
| Left quadriceps | 3.00 | 3.00 | 0.00 | 0.25 |
| Right quadriceps | 3.00 | 3.00 | 0.00 | 0.00 |
| Left gastrocnemius | 3.00 | 3.00 | 0.00 | 0.25 |
| Right gastrocnemius | 3.00 | 3.00 | 0.00 | 0.25 |
| Left Tibialis anterior | 2.75 | 2.50 | 0.00 | 0.00 |
| Right Tibialis anterior | 2.75 | 2.50 | 0.00 | 0.00 |
| Lumbar paraspinals | 3.00 | 3.00 | 0.00 | 0.75 |

Example 27: Dose-Dependent Inhibition of Long CUG Repeat mRNA (HSA$^{LR}$ Mice) and a Short CUG Repeat (HSA$^{SR}$ Mice) by Subcutaneous Administration in Transgenic Mice Dose-dependent inhibition of mRNA transcripts containing a long CUG repeat (HSA$^{LR}$ mice) and a short CUG repeat (HSA$^{SR}$ mice), was evaluated. HSA-short repeat (HSA$^{SR}$) mice express the identical transgene as the HSA$^{LR}$ mice, except that 5 instead of 250 CUG repeats are inserted in the 3′ UTR. HSA$^{SR}$ mice do not have myotonia, splicing changes, or any other observable myotonia phenotype. ISIS 445236 was used in this assay.

Treatment

HSA$^{LR}$ mice were divided into four treatment groups. The first three groups received subcutaneous injections of ISIS 445236 at doses of 2.5 mg/kg, 8.5 mg/kg or 25 mg/kg twice per week for 4 weeks. The fourth group received subcutaneous injections of PBS twice per week for 4 weeks. The PBS-injected group served as the control group to which the oligonucleotide-treated group was compared. HSA$^{SR}$ mice were also divided into four groups and similarly treated.

Inhibition of alpha1 Actin RNA

Twenty four hours after the final dose, the animals were sacrificed and tissue from the quadriceps muscles (left and right), gastrocnemius muscles (left and right), and tibialis anterior muscles (left and right) was isolated. RNA was isolated for real-time PCR analysis of alpha1 actin and normalized to 18s RNA. The results are presented in Tables 38 and 39 and are expressed as percent inhibition of alpha1 actin transcript, relative to the control. Greater inhibition of the nuclear-retained long repeat in the muscle of HSA$^{LR}$ mice was achieved compared with the non-nuclear-retained short repeat in the muscle of HSA$^{SR}$ mice.

TABLE 38

Percent inhibition of human alpha1 actin RNA transcript in HSA$^{LR}$ mice

| Dose (mg/kg) | Quadriceps | Gastrocnemius | Tibialis anterior |
|---|---|---|---|
| 2.5 | 24 | 36 | 46 |
| 8.5 | 53 | 66 | 59 |
| 25 | 86 | 86 | 90 |

TABLE 39

Percent inhibition of human alpha1 actin RNA transcript in HSA$^{SR}$ mice

| Dose (mg/kg) | Quadriceps | Gastrocnemius | Tibialis anterior |
|---|---|---|---|
| 2.5 | 15 | 14 | 0 |
| 8.5 | 30 | 11 | 0 |
| 25 | 59 | 48 | 54 |

Example 28: Dose Response Studies with Antisense Oligonucleotides Targeting Human Dystrophia Myotonica-Protein Kinase (DMPK) in DM1 Fibroblast Cells The mutant form of the DMPK mRNA, harboring large CUG repeats, are fully transcribed and polyadenylated, but remained trapped in the nucleus (Davis et al, 1997, *Proc. Natl. Acad. Sci. U.S.A.* 94, 7388-7393). These mutant nuclear-retained mRNA are one of the most important pathological features of myotonic dystrophy 1 (DM1). Antisense inhibition of mutant DMPK mRNA in DM1 fibroblast cells was studied.

DM1 fibroblast cells were plated at a density of 4,500 cells per well and transfected using Cytofectin reagent with 9.375 nM, 18.75 nM, 37.5 nM, 75 nM, 150 nM, and 300 nM concentrations of each antisense oligonucleotide. After approximately 16 hours, RNA was isolated from the cells and DMPK RNA transcript levels were measured by quantitative real-time PCR using primer probe set RTS3164 (forward sequence AGCCTGAGCCGGGAGATG, designated herein as SEQ ID NO: 164; reverse sequence GCGTAGTTGACTGGCGAAGTT, designated herein as SEQ ID NO: 165; and probe sequence AGGCCATCCGCACGGACAACCX, designated herein as SEQ ID NO: 166). DMPK RNA transcript levels were normalized to total RNA content, as measured by RIBOGREEN®. Results are presented in Table 41 as percent inhibition of DMPK, relative to untreated control cells.

An assay with similar conditions was also performed with primer probe set RTS3162 (forward sequence CGGGCCGTCCGTGTT, designated herein as SEQ ID NO: 167; reverse sequence CTTTGCACTTTGCGAACCAA, designated herein as SEQ ID NO: 168; and probe sequence CATCCTCCACGCACCCCCACCX, designated herein as SEQ ID NO: 169), which targets the 3'-end of the DMPK transcript. Results are presented in Table 42 as percent inhibition of DMPK, relative to untreated control cells.

All the gapmers assayed are described in Table 40 and are 5-10-5 gapmers, where the gap segment comprises ten 2'-deoxynucleosides and each wing segment comprises five 2'-MOE nucleosides. The internucleoside linkages throughout each gapmer are phosphorothioate (P=S) linkages. All cytidine residues throughout each gapmer are 5-methylcytidines. All the gapmers target SEQ ID NO: 170 (the complement of GENBANK Accession No. NT_011109.15 truncated at nucleotides 18540696 to Ser. No. 18/555,106). 'Target start site' indicates the 5'-most nucleotide to which the antisense oligonucleotide is targeted. 'Target stop site' indicates the 3'-most nucleotide to which the antisense oligonucleotide is targeted.

TABLE 40

Chimeric antisense oligonucleotides targeting human dystrophia myotonica-protein kinase (SEQ ID NO: 198)

| Target Start Site | Target Stop Site | ISIS No. | Sequence (5' to 3') | SEQ ID NO |
|---|---|---|---|---|
| 812 | 831 | 299471 | TGCTCCCGACAAGCTCCAGA | 171 |
| 13553 | 13572 | 444401 | TTGCACTTTGCGAACCAACG | 172 |
| 13562 | 13581 | 444404 | AAGAAAGCTTTGCACTTTGC | 173 |
| 13748 | 13767 | 444436 | GTCGGAGGACGAGGTCAATA | 174 |
| 13226 | 13245 | 445569 | CGGAGCGGTTGTGAACTGGC | 175 |

TABLE 41

Dose-dependent antisense inhibition of DMPK mRNA in DM1 fibroblast cells with RTS3164

| ISIS No. | 9.375 nM | 18.75 nM | 37.5 nM | 75.0 nM | 150.0 nM | 300.0 nM | IC$_{50}$ nM |
|---|---|---|---|---|---|---|---|
| 299471 | 10 | 25 | 31 | 47 | 61 | 73 | 86.3 |
| 444401 | 8 | 27 | 41 | 60 | 67 | 74 | 64.3 |
| 444404 | 10 | 21 | 31 | 43 | 55 | 73 | 100 |
| 444436 | 7 | 17 | 36 | 64 | 68 | 70 | 72.3 |
| 445569 | 19 | 31 | 41 | 59 | 46 | 77 | 72.2 |

TABLE 42

Dose-dependent antisense inhibition of DMPK mRNA in DM1 fibroblast cells with RTS3162

| ISIS No | 9.375 nM | 18.75 nM | 37.5 nM | 75.0 nM | 150.0 nM | 300.0 nM | $IC_{50}$ (nM) |
|---|---|---|---|---|---|---|---|
| 299471 | 7 | 25 | 29 | 46 | 48 | 69 | 115.3 |
| 444401 | 20 | 34 | 52 | 72 | 83 | 89 | 35.8 |
| 444404 | 5 | 20 | 28 | 42 | 54 | 77 | 98.8 |
| 444436 | 12 | 15 | 27 | 61 | 68 | 75 | 74.3 |
| 445569 | 5 | 25 | 33 | 53 | 50 | 76 | 89.6 |

Example 29: In Vivo Antisense Inhibition of Human DMPK in Transgenic Mice

LC15 mice, Line A, are transgenic mice containing the entire human DMPK 3'UTR (developed by Wheeler et al, University of Rochester). The mice are the second generation of mice backcrossed to an FVB background. The transgene is expressed in the mice as a CUG repeat RNA, which is retained in the nucleus, forming nuclear inclusions or foci, similar to that seen in human tissue samples of patients with myotonic dystrophy (DM1). There are 350-400 CUG repeats in the DMPK transgene. These mice display early signs of DM1 and do not display any myotonia in their muscle tissues.

ISIS 445569, ISIS 444404, ISIS 444436 and ISIS 473810, which demonstrated statistically significant dose-dependent inhibition in vitro (see Example 5), were evaluated for their ability to reduce human DMPK RNA transcript in vivo.

Treatment

LC15, Line A mice were maintained on a 12-hour light/dark cycle and fed ad libitum normal Purina mouse chow. Animals were acclimated for at least 7 days in the research facility before initiation of the experiment. Antisense oligonucleotides (ASOs) were prepared in PBS and sterilized by filtering through a 0.2 micron filter. Oligonucleotides were dissolved in 0.9% PBS for injection.

The mice were divided into five treatment groups. The first three groups received subcutaneous injections of ISIS 445569, ISIS 444404 or ISIS 444436 at a dose of 25 mg/kg twice per week for 4 weeks. The fourth group received subcutaneous injections of ISIS 473810 at a dose of 12.5 mg/kg twice per week for 4 weeks. The fifth group received subcutaneous injections of PBS twice weekly for 4 weeks. The PBS-injected group served as the control group to which the oligonucleotide-treated group was compared.

Inhibition of DMPK RNA

Twenty four hours after the final dose, the animals were sacrificed and tissue from the quadriceps muscles was isolated. RNA was isolated for real-time PCR analysis of DMPK and normalized to 18s RNA. As presented in Table 43, treatment with antisense oligonucleotides reduced human DMPK RNA transcript expression. The results are expressed as percent inhibition of DMPK transcript, relative to the PBS control.

TABLE 43

Antisense inhibition of human DMPK RNA transcript in LC15 mice

| ISIS No | mg/kg/wk | % inhibition |
|---|---|---|
| 444404 | 50 | 20 |
| 444404 | 50 | 55 |

TABLE 43-continued

Antisense inhibition of human DMPK RNA transcript in LC15 mice

| ISIS No | mg/kg/wk | % inhibition |
|---|---|---|
| 444436 | 50 | 41 |
| 473810 | 25 | 56 |

Assessment of Myotonia by Electromyography

Electromyography on left and right quadriceps, left and right gastrocnemius muscles, left and right tibialis anterior muscles and lumbar paraspinals muscles was performed as previously described (Kanadia et al, 2003, Science, 302: 1978-1980) by using 30 gauge concentric needle electrodes and a minimum of 10 needle insertions for each muscle. Since LC15 mice do not have myotonia, neither the control group nor the treatment groups displayed any myotonia in any muscle tested.

Example 30: In Vivo Antisense Inhibition of Human DMPK in Transgenic Mice

LC15 mice, Line D, are transgenic mice containing the entire human DMPK 3'UTR (developed by Wheeler et al, University of Rochester). The mice are the third generation of mice backcrossed to an FVB background. The transgene is expressed in the mice as a CUG repeat RNA, which is retained in the nucleus, forming nuclear inclusions or foci, similar to that seen in human tissue samples of patients with myotonic dystrophy (DM1). There are 350-400 CUG repeats in the DMPK transgene. These mice display early signs of DM1 and do not display any myotonia in their muscle tissues.

ISIS 445569, ISIS 444404, ISIS 444436 and ISIS 473810 were further evaluated for their ability to reduce human DMPK RNA transcript in vivo.

Treatment

LC15, Line A mice were maintained on a 12-hour light/dark cycle and fed ad libitum normal Purina mouse chow. Animals were acclimated for at least 7 days in the research facility before initiation of the experiment. Antisense oligonucleotides (ASOs) were prepared in PBS and sterilized by filtering through a 0.2 micron filter. Oligonucleotides were dissolved in 0.9% PBS for injection.

The mice were divided into six treatment groups. The first three groups received subcutaneous injections of ISIS 445569, ISIS 444404 or ISIS 444436 at a dose of 25 mg/kg twice per week for 4 weeks. The fourth group received subcutaneous injections of ISIS 473810 at a dose of 12.5 mg/kg twice per week for 4 weeks. The fifth group received subcutaneous injections of ISIS 473810 at a dose of 6.25 mg/kg twice per week for 4 weeks. The sixth group received subcutaneous injections of PBS twice weekly for 4 weeks. The PBS-injected group served as the control group to which the oligonucleotide-treated group was compared.

Inhibition of DMPK RNA

Twenty four hours after the final dose, the animals were sacrificed and tissue from the quadriceps muscles was isolated. RNA was isolated for real-time PCR analysis of DMPK and normalized to 18s RNA. As presented in Table 44, treatment with antisense oligonucleotides reduced human DMPK RNA transcript expression. The results are expressed as percent inhibition of DMPK transcript, relative to the PBS control.

TABLE 44

Antisense inhibition of human DMPK RNA transcript in LC15 mice

| ISIS No | mg/kg/wk | % inhibition |
|---------|----------|--------------|
| 444404  | 50       | 24           |
| 444404  | 50       | 30           |
| 444436  | 50       | 17           |
| 473810  | 25       | 7            |
| 473810  | 12.5     | 18           |

Assessment of Myotonia by Electromyography

Electromyography on left and right quadriceps, left and right gastrocnemius muscles, left and right tibialis anterior muscles and lumbar paraspinals muscles was performed as previously described (Kanadia et al, 2003, Science, 302: 1978-1980) by using 30 gauge concentric needle electrodes and a minimum of 10 needle insertions for each muscle. Since LC15 mice do not have myotonia, neither the control group nor the treatment groups displayed any myotonia in any muscle tested.

Figure 1B:
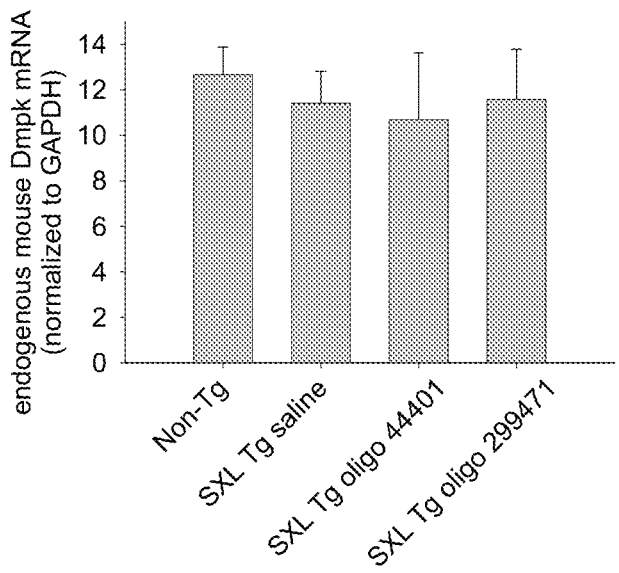
FIG. 1B shows the results of a Taqman assay for endogenous mouse Dmpk mRNA.

Example 31: In Vivo Antisense Inhibition of Human DMPK in SXL Transgenic Mouse Model Using hDMPK-targeting ASOs 444401 and 299471 target knockdown in soleus muscle was measured in SXL mice. The SXL mouse is transgenic for the entire DMPK gene and promoter and contains a 1000 CUG repeat sequence in the 3'UTR of DMPK gene. Mice were dosed 50 mg/kg twice weekly for 4 weeks (n=3 mice per group, except n=2 for saline-injected controls). Results of Taqman assays are shown in FIG. 1 for mut-hDMPK mRNA (FIG. 1A) and endogenous mouse Dmpk mRNA (FIG. 1B).

Example 32: In Vivo Inhibition of snoRNAs

ISIS 462026 (targeting U16) and ISIS 477499 (targeting U50), demonstrating significant inhibition of their respective snoRNAs, were tested in mice and the efficacy of the gapmers was evaluated.

Treatment

Two groups of five seven-week old balb-c mice were each administered subcutaneously with 100 mg/kg of ISIS 462026 or ISIS 477499. Another group of five mice was injected with 100 mg/kg of control oligonucleotide ISIS 141923 (CCTTCCCTGAAGGTTCCTCC, designated herein as SEQ ID NO: 176). Another group of five mice were injected subcutaneously with PBS. The mice injected with PBS served as a control group. The mice were sacrificed 72 hours later and several tissues were harvested for target mRNA analysis. Tissues harvested were: liver, heart, spleen, white adipose tissue (WAT), kidney, and muscle.

RNA Analysis

Figure 2:
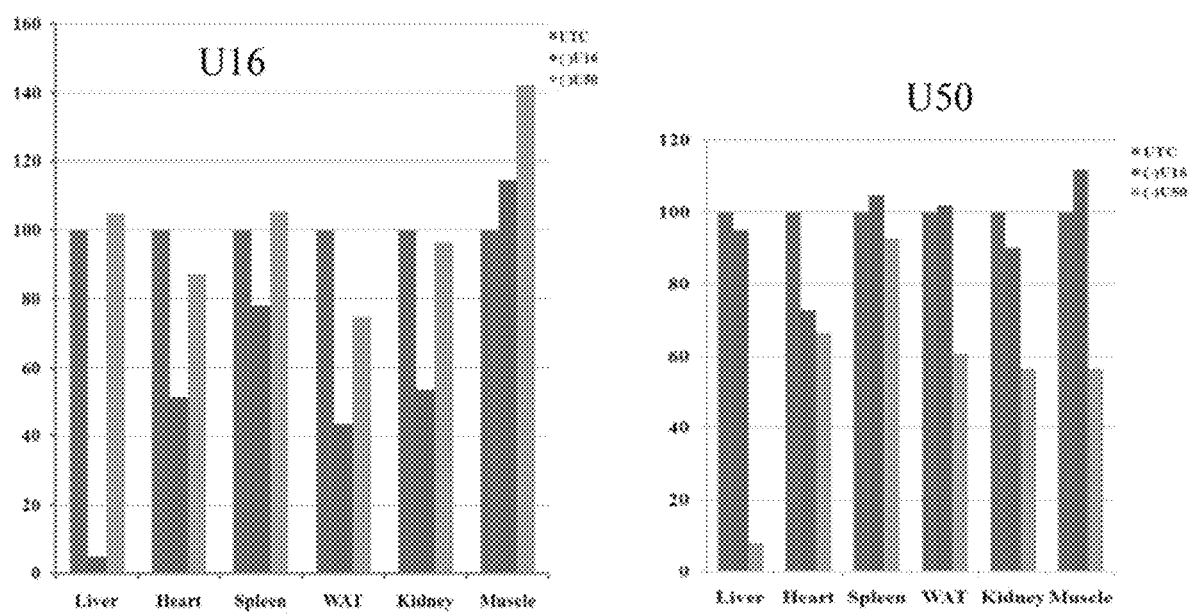
FIG. 2 shows the in vivo reduction of U16 and U50 snoRNA in various tissues.

Total RNA from each of the various tissues was separately prepared using Tri-Reagent, based on the manufacturer's instructions. Five micrograms of total RNA was separated in 8% polyacrylamide-7M urea gels and was transferred onto a membrane, using semi-dry transfer apparatus. Northern hybridization was performed using U16 snoRNA-specific 5'-end labeled oligonucleotide probe (5'-TTGCTCAG-TAAGAATTTTCG-3', designated herein as SEQ ID NO: 177), and U50 snoRNA-specific 5'-end labeled oligonucleotide probe (5'-GGTTCGGGATAAGATCATCACA-3', designated herein as SEQ ID NO: 178). U2 snRNA were detected and served as a control for loading. The density of the bands was scanned using an ImageJ densitometer. Results for inhibition are presented in FIG. 2. The data indicates that ISIS 462026 and ISIS 477499 significantly inhibited their target snoRNA expression.

Evaluation of rRNA Methylation

Total RNA from liver samples was pooled for each group and subjected to primer extension analysis to detect rRNA methylation at positions A485 in 18S rRNA, targeted by U16 snoRNA, or C2613 in 28S rRNA, targeted by U50 snoRNA. The results are presented in Table 45 and demonstrate significant inhibition at 0.05 mM dNTP concentration, compared to the PBS control.

TABLE 45

Inhibition of rRNA methylation by antisense oligonucleotides in mouse livers relative to the PBS control

| ISIS No | % inhibition of rRNA methylation |
|---------|----------------------------------|
| 462026  | >95                              |
| 477499  | >93                              |

Example 33: In Vitro Inhibition of lincRNA_SFPQE, lincRNA_p21, lincRNA_HOXA1, HOTAIR, PCGEM1, and MIAT mRNA Antisense oligonucleotides were designed targeting lincRNA_SFPQE, lincRNA_p21, lincRNA_HOXA1, HOTAIR, PCGEM1, and MIAT mRNA sequences. The antisense oligonucleotides were tested in vitro. Various doses of antisense oligonucleotides were individually tested in various cells and the mRNA expression levels of the corresponding targets were analyzed by RT-PCR.

The results indicated that the antisense oligonucleotides for nuclear-retained RNAs, such as lincRNA_SFPQE, lincRNA_p21, lincRNA_HOXA1, HOTAIR, PCGEM1, and MIAT, were able to reduce their target mRNA sequences with a potency similar to that demonstrated by antisense oligonucleotides targeting MALAT1 (see Examples 1-6).

SEQUENCE LISTING (178 sequences)

SEQ ID NO: 1 - DNA, 8708 bp, Homo sapiens
gtaaaggactggggccccgcaactggcctctcctgccctcttaagcgcagcgccattttagcaacgcagaagcccggcgccgggaagcctcagctcgcctgaaggcaggtcccctctgacgcctccgggagcccaggtttcccagagtccttgggacgcagcgacgagttgtgctgctatcttagctgtccttataggctggccattccaggtggtggtatttagataaaaccactcaaactctgcagtttggtcttggggtttggaggaaagcttttatttttcttcctgctccggttcagaaggtctgaagctcatacctaaccaggcataacacagaatctgcaaaacaaaaacccctaaaaaagcagacccagagcagtgtaaacacttctgggtgtgtccctgactggctgcccaaggtctctgtgtcttcggagacaaagccattcgcttagttggtctactttaaaaggccacttgaactcgctttccatggcgatttgccttgtgagcactttcaggagagcctggaagctgaaaaacggtagaaaaatttccgtgcgggccgtggggggctggcggcaactggggggccgcagatcagagtgggccactggcagccaacggcccccggggctcaggcggggagcagctctgtggtgtgggattgaggcgttttccaagagtgggttttcacgtttctaagatttcccaagcagacagcccgtgctgctccgatttctcgaacaaaaaagcaaaacgtgtggctgtcttgggagcaagtcgcaggactgcaagcagttgggggagaaagtccgccattttgccacttctcaaccgtccctgcaaggctggggctcagttgcgtaatggaaagtaaagccctgaactatcacactttaatcttccttcaaaaggtggtaaactatacctactgtccctcaagagaacacaagaagtgctttaagaggtattttaaaagttccgggggttttgtgaggtgtttgatgacccgtttaaaatatgatttccatgtttcttttgtctaaagtttgcagctcaaatctttccacacgctagtaatttaagtatttctgcatgtgtagtttgcattcaagttccataagctgttaagaaaaatctagaaaagtaaaactagaacctatttttaaccgaagaactactttttgcctccctcacaaaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctctaaa

SEQ ID NO: 2 - DNA, 158 bp, Homo sapiens
aatcaacccgagtgcaatcgaatggaatcgaatgaatggaatgcaatggaatggattcaacttgaatggaatggaaagaatggaatcaacacgagtggaatggcatggattggaatggaatggaatggaatcaacccgagtacaggaatggaatggaa

SEQ ID NO: 3 - DNA, 1641 bp, homo sapiens
ttattgtggtttgtccgttccgagcgctccgcagaacagtcctccctgtaagagcctaaccattgccagggaaacctgccctgggcgctcccttcattagcagtattttttttaaattaatctgattaataattatttttcccccatttaattttttttcctcccaggtggagttgccgaagctgggggcagctggggagggtggggatgggaggggagagacagaagttgagggcatctctctcttccttcccgaccctctggcccccaaggggcaggaggaatgcaggagcaggagttgagcttgggagctgcagatgcctccgcccctcctctctcccaggctcttcctcctgcccccttcttgcaactctccttaattttgtttggcttttggatgattataattatttttatttttgaatttatataaagtatatgtgtgtgtgtgtggagctgagacaggctcggcagcggcacagaatgagggaagacgagaaagagagtgggagagagagaggcagagagggagagagggagagtgacagcagcgctcgagacggacggcaagcggtcccgaaccagttacacgcgctaccagactctggaactcgagaaagaattccactttaaccgctacctcactcgccgcaggcgcatagagatcgccaacaacttgtgtctcaatgagagacagatcaagatctggttccagaaccgcaggatgaagtggaagaaagattccaaaatgaaaagcaaagaggctctttagaggcagcgggggaggcccgcagagcgcgcccctagccggttcctgtccctgcgcctttccttttcgcctttcctctctatatttcgggtcgggggcaggtgctggagcactgggctcccgggccccacagacaaaagcgcttttccttggcattccgcatccctaccgacccagggttcccgcggggctgtcggcgctgccccatctcccctcagctcggctcagctcggtacccggggcccagggcaagctccgcaggacttccccggagggctgcggcgtacaggctggcgcagaacgaaccttggcctgggccgtatctccggctcccagcctcagcgcggccctcccgagttaaggtgggcccggcccgcgccacaggaccctcgccggaccctctaacctcgccctctcctttgttcccggctggacgggttagacagccaaaggctggcgagagtctggccctagactcggggtgcttccttgtagcgactaaactagattttcacttatgaatgatttgcatatgaaaggagagcatcggcctagggcccccacagttgctctatgctttccaaaccttatctccacaacctcttccccccaaaacccgggaacctccccagcctgcgcctgctgcatgccctctcaggccggcagccccagcctgctagctagctcaactagtggggtttcctggcactggaccccagcaagtggtcctagaggccctttgctgtcccatagtccctgccacgaatttctgtgccctcctgacccattgctgttgtccaactatttattgactctgggtccttcctgaaactatattttgtcatatcaaataaagagagaacaggactaaa

SEQ ID NO: 4 - DNA, 22743 bp, Homo sapiens
ggagttagcgacagggagggatgcgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcgtcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctctggatgtgagcattgctttgtctgctggtgactgaacatctctaccttgtgtcaattggccatttgtggtgtgtgtgtgtgtgcgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttgtcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctatgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtgtatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctcagactgtgtgtgtgtgtgtgtgtgtgtgtgtgtgtgtgtgtgtgtgtgtgtgtgtgtgtgtgtaaaagagagaagttgtggagaaatggggggctgattctgctcagattcatcaggatgagtagaaggcacccagctctcaccctggcctgacatgtgtgtccctgagcaggttacagtcctctctgagcctctgcttcccatctggaccctgctgggcagggcttctgagctccttagcactagcaggaggggctccaggggccctccctccatggcagccaggacaggactctcaaatgaggacagcagagctcgtggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacagctgacggtggctgacagatcagagaatggaaggcgaggcaggcgggcgtctgcgtgacctcaggtgcttggggcccagcagacccagagaaccatttccactaggccagggtgccggaagtgtccacaggtcttagattccctgttcagatgaaaagatttgtgcctttaatgataaaagtgatctgcatagagtcaaaaattcaagccatgggtataaaatgcaagtaaaatccctgccctcacctatcccaccctactacacagagatgtcctctcgagtttcctagactcactctggaaatttctgtatacacacagaagcttgtgcctctgctcgtgaaggcagagggagggagagctgaagggccagcaccttctcacctgtgggccccctcagtgctcggtcccagagcatgcaggactgtgcctcgtgttcagtttgctggtctgacttcatgctccttgggcaggatatgcatgtgccatgctaggagacatgtggatgtgaagctgggggacaatgtcccctggctatgcctttacaagggaagtaaggaaggtaggaggtgagcctgggagggagggagggaggcgcggagccgccgcaggtgtttcttttactgagtgcagcccatggccgcactcaggttttgcttttcaccttcccatctgtgaaagagtgagcaggaaaaagcaaaa

SEQ ID NO: 5 - DNA, 17357 bp, Homo sapiens
ggagttagcgacagggagggatgcgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcgtcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctctggatgtgagcattgctttgtctgctggtgactgaacatctctaccttgtgtcaattggccatttgtggtgtgtgtgtgtgtgcgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttgtcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctatgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtgtatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttt

SEQ ID NO: 6 - DNA, 8708 bp, Homo sapiens; identical to SEQ ID NO: 1

SEQ ID NO: 7 - DNA, 14084 bp, Drosophila melanogaster
actctcaaatgaaaagtgttcaagtgcattcaaagtgaagctgaaaaaataaccagttaaaaatagtacaaagaaattttctttcttgcaatttgcaagcagtagctacaaccaaaaatggaaaagtgtaaaaatcgtgtcccagcagacgagcagcagcagtacgagtattgcaaaatgcaggggcaagggcccacgtagtatttttccacgtcgggcatttaatgctctcgagttggaaacaatgaaaccatacgcaaaccccctggaaaagatgtgattagtcatcgattttgctggtcagcgtcggggaatttcgcaatgcagcaggcagttttctcaaatttggctagaaagtgacccactaggcagtctgaggcagttatccaggatgtaaggatgtgtgcagtactctctgtgtcgaatggcgatggccctgacctgcggattttgaaagattgaaataggaagccaggtatacatacacagcaacgaatgcagcgtgttctatattcttaattcgtaagccaaacctatgtttaagacgtagtttatataaccgtacatatgtatgtagcgaaacacgttttcaaacgtcgcatcgaagccatttcttctgcagccattgcaatttcatcgtgttgcgtaatcgcaaattgtaaatgtgtccctactacttcacatttgtgtgtatccaagtcgaaagttctcgaactattctcgtgagcaacccccggatcgaaaggccaccaactggctcgttctctctctccagaaacagcttactcttacgtttacaattgactctctacctatcgggtatacacatttttatatatgtatacactcagagacaccccaatcccccaccatacatatggcgagatgtgtgaatgtatcgcagttggacgaaaacggcagctgcgcagaaaacgctgcggcgtacatacaaacgagctctttgtttgcctttccccagttttgcttccccatacgtataactggtgtttatcagcggtaatctcgccagcctgactttgtccctgtcgcttctattgacattctaaactagattgtagacgttttaacatttacctagctgttaatcttatttgtaaacatctctatatgcaacctgccataccacttaaccaagcaatatgtatttctttctctaaactttatagttgggcgttgaaagttgatatcgatatcgatccgtgaaaagtcgataccctgcgcaagcatggggcggcatatgggtgctgaaaacgcactcggcccgatcccgattgcagcgttattcgaaagctgtgtctgcgaccgtgactgagatcatatgcgtacatatatctaatgtccggggtcgtaggccagccagggtgctcgattctgtcagattgattgtgcggattgtgttataggaacactggtgtatcgacttctctgctccactatgggtgaaggataccctaccgaaaaggccttctgtcgcttactatcatcgaacaagttccgtaaagggcagacatacgtacacgtggcagcatattacgttcaatgacacatcgtctctggattagtagttgaaccaacgagctcgaatataccctgccagttggttgtaaatattaattttgttcttatattcagttgtaaagtcaatacggaagacatttccacaccaaccatgtgtcacttatgttcttaaataccagaaactgtttaaatttttgttcttatacacttcaccaattaagaattacctgtactgatgtaagtgtacctgttgaatcacaacaaaaatagaaaaaatgaataacaaaagagctctataacagaaaagccacagaaaaagtgaataaaaattcaaaaattcaaaaaataaatttcgaaacatttgctcgtgatatttttatttcaagaaaagatccgatttcagttataccatctagcttaaatttagcgttacgagaatagtccctcggaggaaaggccctttatcaagatgccaatatcgttcgtcctatacacaaattactcacgttatgaaaccaagtcgaaaaatcggacaaagtgtctacaattgaggaaaggtctattgatctcctgtgagcgcaaaaagtttgtattcgaacgagaattttaaggtttaaaatcagctgaaaagtacgtatattccgcatttatttttctccacatttttaggatcagaacatcagaactatatttttttggaaaaatcaacggatattattttgtttggaggtcccaaattctatacaccttcacacatatttttgcatacaaaaaaacctaaaaataatattattgaatggcaaaaaaaaccatttataacatgaaaattactcgaagtacttcaatttaattaccgaaccaaaatatatacacgtacgactcgtgttggacgagattacattaagagaactttgaaaaataataaaaaaaggtttgaaattgaaaactgtaaagtataatattcgtaataaggaatttataaagataaataaccacaacaaaatgaaccacaataatatgaaaccatgaacaataggtatgatttatgtcgattagcctcttggtaaaataaacttaaaatccatataggtgtgtgttataaaactgccccaattcaaaattgcgtctcgtaataaaccaaaagtacatcgtacaactgcaacatgacccgcaattatttgaactctttaacaataggtttcatttactccgattaccccaatcacaatctttcgaaaaggcttagcctcttggtaaaatacccttaaaatccatataagtagggtgtgatataaaactatcccaattcaaaatcgcgtcacataataaacaacaaattaaagcatcttaaagggtctaatttttaggacatattaatttacttaataggtaggaattgaacatacggtatttttatatggtatatcttaacaactgcaacatgacccacacttttatgaactctttaataatggttattataaaacccgattaccttaatcattatccttcgaaaaggacatgcaacatgacccacacttttatgaactctttaataatggttttgataaaacccgattaccttaatcatcatccttcgaaacggcttatcctcttggtaaaatacacttaaaatccatataggtagggtgtgatataaaacgttcccaattcaaaatcgcgtcacataataaacaaaaagttaaagcatcttaaaaggactgatatataggacatattaatttacttaataggtaggaattgaacatacggtatttttatatggtatatcttaacaactgcaacatgacccacacttttatgaactctttaataatggttattataaaacccgattaccttaatcattatccttcgaaaaggcttatcctcttggtaaaatacacttaaaatccatataggtagggtgtgatataaaacgttcccaattcaaaatcgcgtcacataataaacaaagagttaaagcatcttaaaaggactgatatataggacatattaatttacttaataggtaggaattgaacatacggtatttttatatggtatatcttaacaactgcaacatgacccacacttttatgaactctttaataatggttttgataaaacccgattaccttaatcatcatccttcgaaaactcttatcctcttggtaaaatacacttaaaatctatataggtagggtgtgatataaaacgttcccaatttaaaatcgcgtcacataataaacaagaaattaaagcatcttaaagggtctaatttttaggacatattaatttacttaataggtaggaattgaacatacggtatttttatatggtatatcttaacaactgcaacatgacccacacttttatgaactctttaataatggttttgataaaacccgattaccttaatcattatccttcgaaaaggcttatcctcttggtaaaatacacttaaaatccatataggtagggtgtgatataaaacgttcccaattcaaaatcgcgtcacataataaacaaagagttaaagcatcttaaaaggactgatatataggacatattaatttacttaataggtaggaattgaacacacgctatttttatatggtatatcttaacaacagcaacatgacccacacttttatgaactctttaataatggttttgataaaacccgattaccttaatcattatccttcgaaaaggcttatcctcttggtaaaatacacttaaaatccatataggtagggtgtgatataaaacgttcccaattcaaaatcgcgtcacataataaacaaagagttaaagcatcttaaaaggactgatatataggacatattaatttacttaataggtaggaattgaacatacggtatttttatatggtatatcttaacaactgcaacatgacccacacttatgaactctttaataatggttattataaaacccgattaccttaatcattatccttcgaaaaggcttatcctcttggtaaaatacacttaaaatctatataggtagggtgtgatataaaacgttcccaattcaaaatcgcgtcacataataaacaaagagttaaagcatcttaaaaggactgatatataggacatattaatttacttaataggtaggaattgaacatacggtatttttatatggtatatcttaacaactgcaacatgacccacacttttatgaactctttaataatggttttgataaaacccgattaccttaatcattatccttcgaaaaggcttatcctcttggtaaaatacacttaaaatccatataggtagggtgtgatataaaacgttcccaattcaaaatcgcgtcacataataaacaaagagttaaagcatcttaaaaggactgatatataggacatattaatttacttaataggtaggaattgaacacacgctatttttatatggtatatcttaacaactgcaacatgacccacacttttatgaactctttaataatggttatgataaaacccgattaccttaatcattatccttcgaaaaggcttatcctcttggtaaaatacacttaaaatccatataggtagggtgtgatataaaacgttcccaattcaaaatcgcgtcgcataataaacaaaaagttaaagcatcttaaaaggactgatatataggacatatgaatttacttaataggtaggaattgaacatacggtatttttatatggtatatcttaacaactgcaacatgacccacacttttatgaactctttaataatggttatgataaaacccgattaccttaatcattatccttcgaaaaggcttatcctcttggtaaaatacacttaaaatccatataggtagggtgtgatataaaacgttcccaattcaaaatcgcgtcacataataaacaaagagttaaagcatcttaaaaggactgatatataggacatattaatttacttaataggtaggaattgaacacacggtatttttatatggtatatcttaacaactgcgacatgacccacaattttatgaacttaacaataggttttatttatcccgattaccccaatcactatccttcgaaaaggcttatcctcttggtaaaatacacttaaaatccatataggtagggtgtgatataaaacgttcccaattcaaaatcgcgtcacataataaacaagaaattaaagcatcttaaagggtctaatttttaggacatattaatttacttaataggtaggcattgaacatacggtatttttatatggtatatcttaacaactgcaacatgacccacacttttatgaactctttaataatggttattataaaacccgattaccttaatcattatccttcgaaaaggacatgcaacatgacccacacttttatgaactctttaataatggttttgataaaacccgattaccttaatcattatccttcgaaaaggcttatcctcttggtaaaatacacttaaaatccatataggtagggtgtgatataaaacgttcccaattcaaaaccgcgtcacataataaacaaaaagttaaagcatcttaaaaggactgatttataggacatattaatttacttaataggtaggaattgaacatacggtatttttatatggtatatcttaacaactgcgacatgacccacaattttatgaacttaacaataggttttatttatcccgattaccccaatcattatccttcgaaaaggcttatcctcttggtaaaatacacttaaaatccatataggtagggtgtgatataaaacattcccaattcaaaatcgcgtctcgtaataaacaagaaattaaagcatcttaaagggtctaatttttaggacatactaatttacttaataggtaggcatttaacatacggtatttttatatggtttatcttaacaactgcaacatgacccacaattttatgaactctttaccaataggttttatttatcccgattaccccaatcactatccttcgaaaaggcttatcctcttggtaaaatacccttaaaatccatataagtagggtgtgatataaaactatcccaattcaaaatcgcgtcacataataaacaagaaattaaagcatcttaaagggtctaatttttaggacatattaatttacttaataggtaggcattgaacatacggtatttttatatggtatatcttaacaactgcaacatgacccacaactttatgaactctttaccaataggttttatttatcccgattaccccaatcactatccttcgaaaaggcttatcctcttggtaaaatacacttaaaatccatataggtagggtgtgatataaaactatcccaaatcaaaatcgcgtcacataataaacaagaaattaaagcatcttaaagggtctaatttttaggacataaatttacgtaataggtaggaattgaacacacggtatttttatatggtatatcttaacaactgcaacatgacccacaactttatgaactctttaccaataggttttatttatcccgattaccccaatcactatccttcgaaaaggcttatcctcttggtaaaatacccttaaaatccatataggtagggtgtgatatataactatcccaaatcaaaatcgcgtcacataataaacaagaaattaaagcatcttaaagggtctaatttttaggacatattaatttacttaataggtaggaattgaacacacggtatttttatatggcatatcttaacaactgcaacatgacccacacttttatgaactctttaataatggttatgataaaacccgattaccttaatcattatccttcgaaaaggcttatcctcttggtaaaatacacttaaaatccatataggtaaggtgtgatataaatcgttcccaattcaaaatcgcgtcacataataaacaaaaagttaaagcatcttaaaaggactgatttttaggacatattaatttacttaataggtaggcattgaacatacggtatttttatatggtatatcttaacaactgcaacatgacccacacttttatgaactctttaataatggttattataaaacccgattaccttaatcattatccttcgaaaaggacatgcaacatgacccacacttttatgaactctttaataatggttttgataaaacccgattaccttaatcattatccttcgaaaaggcttatcctcttggtaaaatacacttaaaatccatataggtagggtgtgatataaaacattcccaattcaaaatcgcgtctcgtaataaacaagaaattaaagcatcttaaagggtctaatttttaggacatactaatttacttaataggtaggcatttaacatacggtatttttatatggtttatcttaacaactgcaacatgacccacaattttatgaactatttaccaataggttttatttatcccgattaccccaatcactatccttcgaaaaggcttatcctcttggtaaaatacccttaaaatccatataagtagggtgtgatataaaactatcccaattcaaaatcgcgtcacataataaacaagaaattaaagcatcttaaagggtctaatttttaggacatattaatttacttaataggtaggcattgaacatacggtatttttatatggtatatcttaacaactgcaacatgacccacaactttatgaactctttaccaataggttttatttatcccgattaccccaatcactatccttcgaaaaggcttatcctcttggtaaaatacccttaaaatccatataagtagggtgtgatataaaactatcccaattcaaaatcgcgtcacataataaacaagaaattaaagcatcttaaagggtctaatttttaggacatattaatttacttaataggtaggcattgaacatacggtatttttatatggtatatcttaacaactgcaacatgacccacaactttatgaactctttaccaataggttttatttatcccgattaccccaatcactatccttcgaaaaggcttatcctcttggtaaaatacacttaaaatccatataggtagggtgtgatataaaactatcccaaatcaaaatcgcgtcacataataaacaagaaattaaagcatcttaaagggtctaatttttaggacataaatttacgtaataggtaggaattgaacacacggtatttttatatggtatatcttaacaactgcaacatgacccacaactttatgaactctttaccaataggttttatttatcccgattaccccaatcactatccttcgaaaaggcttatcctcttggtaaaatacccttaaaatccatataggtagggtgtgatatataactatcccaaatcaaaatcgcgtcacataataaacaagaaattaaagcatcttaaagggtctaatttttaggacatattaatttacttaataggtaggaattgaacacacggtatttttatatggcatatcttaacaactgcaacatgacccacacttttatgaactctttaataatggttatgataaaacccgattaccttaatcattatccttcgaaaaggcttatcctcttggtaaaatacacttaaaatccatataggtagggtgtgatataaatcgttcccaattcaaaatcgcgtcacataataaacaaaaagttaaagcatcttaaaaggactgatttttaggacatattaatttacttaataggtaggaattgaacacacggtatttttatatggcatatcttaacaactgcaacatgacccacaattttatgaactctttaataatggttatgataaaacccgattaccttaatcattatccttcgaaaaggcttatcctcttggtaaaatacacttaaaatccatataggtagggtgtgatataaatcgttcccaattcaaaatcgcgtcacataataaacaaaaagttaaagcatcttaaaaggactgatttttaggacatattaatttacttaataggtaggaattgaacacacggtatttttatatggcatatcttaacaactgcaacatgacccacaattttatgaactctttaataatggttatgataaaacccgattaccttaatcattatccttcgaaaaggcttatcctcttggtaaaatacacttaaaatccatataggaagggggtgatataaaactatcccaattcaaaatcgcgtcacataataaacaaaaagttaaagcatcttaaaaggactgatttttaggacatattaatttacttaataggtaggaattgaacacacggtatttttatatggcatatcttaacaactgcaacatgacccacaattttatgaactctttaataatggttatgataaaacccaattaccttaatcattatccttcgaaaactcttatcctcttggtaaaatacacttaaaatctatataggtagggtgtgatataaaacgttcccaatttaaaatcgcgtcacataataaacaaaaagttaaagcatcttaaaaggactgatttttaggacatattaatttacttaataggtaggaattgaacacacggtatttttatatggcatatcttaacaactgcaacatgacccacacttttatgaactctttaataatggttatgataaaacccgattaccttaatcattatcattcgaaaaggcttatcctcttggtaaaatacacttaaaatccatataggtagggtgtgatataaaacgttcccaattcaaaatcgcgtcacataataaacaaagagttaaagtatcttaaaaggactgatttataggacatattaatttacttaataggtaggaattgaacacacggtatttttatatggcatatcttaacaactgcaacatgacccacacttttatgaactctttaataatggttatgataaaacccgattaccttaatcattatccttcgaaaaggcttatcctcttggtaaaatacacttaaaatccatataggtagggtgtgatataaaactatcccaattcaaaatcgcgtcacataattaacaaaaagttaaagcatcttaaaaggactgatttttaggacatattaatttacttaataggtaggaattgaacacacggtatttttatatggcatatcttaacaactgcaacatgacccacaactttatgaactctttaccaataggttttatttatcccgattaccccaatcactatccttcgaaaaggcttatcctcttggtaaaatacccttaaaatccatataggtagggtgtgatatataactatcccaaatcaaaatcgcgtcacataataaacaagaaattaaagcatcttaaagggtctaatttttaggacatattaatttacttaataggtaggaattgaacacacggtatttttatatggcatatcttaacaactgcaacattacccacaattttatgaactctttaataatggttatgataaaacccgattaccttaatcattatccttcgaaaaggcttatcctcttggtaaaatacacttaaaatccatataggtagggtgtgatataaatcgttcccaattcaaaatcgcgtcacattataaacaaaaagttaaagcatcttaaaaggactgatttttaggacatattaatttacttaataggtaggaattgaacacacggtatttttatatggcatatcttaacaactgcaacatgacccacaattttatgaactctttaataatggttatgataaaacccgattaccttaatcattatccttcgaaaaggcttatcctcttggtaaaatacacttaaaatccatataggtagggtgtgatataaatcgttcccaattcaaaatcgcgtcacattataaacaaaaagttaaagcatcttaaaaggactgatttttaggacatattaatttacttaataggtaggaattgaacacacggtatttttatatggcatatcttaacaactgcaacatgacccacaattttatgaactctttaataatggttatgataaaacccgattaccttaatcattatccttcgaaaaggcttatcctcttggtaaaatacacttaaaatccatataggtagggtgtgatataaaacgttcccaattcaaaatcgcgtcacataataaacaaagagttaaagtatcttaaaaggactgatttataggacatattaatttacttaataggtaggaattgaacacacgttatttttatatggtatatcttaacaactgcaaacatgccccacaattttatgaactctttaataatggttatgataaaacccgattaccttaatcattatccttcgaaaaggcttatcctcttggtaaaatacacttaaaatctatataggtagggtgtgatataaaacgttcccaatttaaaatcgcgtcacataataaacaagaaattaaagcatcttaaagggtctaatttttaggatatattaatttacttaataggtaggaattgaacacacggtatttttatatggcatatcttaacaactgcaacatgacccacacttttatgaactctttaataatggttatgataaaacccgattaccttaatcattatccttcgaaaaggcttatcctcttggtaaaatacacttaaaatccatataggtagggtgtgatataaaactatcccaattcaaaatcgcgtcacataataaacaaaaagttaaagcatcttaaaaggactgatttttaggacatattaatttacttaataggtaggaattgaacacacggtatttttatatggcatatcttaacaactgcaacatgacccacacttttatgaactctttaataatggttatgataaaacccgattaccttaatcattatccttcgaaaaggcttatcctcttggtaaaatacacttaaaatccatataggtagggtgtgatataaaactatcccaattcaaaatcgcgtcacataattaacaaaaagttaaagcatcttaaaaggactgatttttaggacatattaatttacttaataggtaggaattgaacacacggtatttttatatggcatatcttaacaactgcaacatgacccacaattatatgaactctttaataatggttatgataaaacccaattaccttaatcattatccttcgaaaactcttatcctcttggtaaaatacacttaaaatctatataggtagggtgtgatataaaacgttcccaatttaaaatcgcgtcacataataaacaagaaattaaagcatcttaaagggtctaatttttaggatatattaatttacttaataggtaggaattgaacatacggtatttttatatggtatatctaaacaactgcaacatgacccacaattttatgaactcttgaataatggttatgataaaacccgattaccttaatcattatccttcgaaaaggcttatcctcttggtaaaatacacttaaaatccatataggtagggtgtgatataaaaatatcccaattcaaaatcgcgtcacataataaacaagaaatcaaatcatctaaaaggtctaatttttaggatatattaatttacttaataggtaggcattaaacatacggtatttttatatggtatatcttaacaactgcaacatgacccacaattttatgaactctataacaataggttttatttatcccgattaccccaatcactatccttcgaaaataaattttaaaataaataaaaataaactttaaatccatataggttgggtgtattacacaagggtctcaatttaaaatcgcgtctcataataaacaaaacataaagcaacttaaaaggtgtgatttttgagacatgctaatttaatatccgtcgaaaaggaatatgctcttggtcaaataaactttccaattcaaatgtccgtaacctatgatttaagataatatcctacttacatcctacacttacattatttttttttttttgtgttattttatatcaaccacaataatacaagcccctcaattatatgtatgatatatttcgattaccccaaaccaaaaagtaaaactagatttggattaggattttaaaagaatgacaacatataatgtaggactctgagattaacagcatatctttgtgcattttatgttgtaatttgaaattgtttttgttttacttcttatttgtataatttattcatttatgcgacctcaattttgagttctagtatttttgtgtttataatgtgtttgtgtggattgagtcaaaaatgattaatgtcgcattcatttgtaaaggaatagttgcttggaaataaaaaaaacacgaaaactaataacgtaatataccctattaccctggtaattattttgaaaattcaatagaaaatttgaaaagaaaattaccgaaatgaacaagggaaaacagtttaaaattaacaatttactgaacaagtttaaactaaagaaatccgcccgcattcaagct

SEQ ID NO: 8 - DNA, 2068 bp, Arabidopsis thaliana
gaccattcatcaaaagccacataagaagttgatgcagaagcaataataacaaaacaaaaaaacattaaaaaaaaaagctcttcagttttggtttctgcagtctccaatggctctcaagctctttctctttgctcttcttctctgtctcccgacttctctctcctccactgcctctaaaggtaaagagaagaagtcgaagtttaatccatacagatacacattcatcgataaagcaagcacattctcatcatcttcctcatcttcattttcatccaacggtcaagattcgtcctacgactacatagtcatcggaggtggaaccgcagggtgtcctctcgccgcaacgttgtcgcagaatttcagcgttcttgttttagagagaggtggcgttccgtttacaaacgcaaacgtttctttcctcaggaattttcacatcggacttgctgacatttcagcttcttccgcgtctcaagcgtttgtttccactgacggcgtttacaacgcccgtgctagagttctcggtggcggttcctgtattaacgccggtttttactccagagccgatgctgcgttcgtgaagcgagcaggatgggatccgaagctggtgaaggagtcgtatccatgggtggagagagagattgttcatcagccaaagttaacgttatggcagaaagctctcagagacagtcttttagaggttggagtcagacctttcaatggtttcacttacgatcacgtttccggaaccaaaatcggcggtacaattttcgacagattcggccgtcgtcacaccgcggcggagcttctcgcttacgctaatcctcagaagcttagagtcttgatctacgccaccgtgcaaaaaatcgtctttgacacttctggaacaaggcctcgagtaacaggagtaatattcaaagatgagaaaggtaatcaacaccaggctttactctcgaatagaaagggaagtgaagtgatcttatctagtggagctattgggtcaccacagatgctgatgttaagtgggattggacctaagaaggagcttcagaggctgaagattcctgtggttttagagaatgagcatgtaggaaaaggaatggctgataatcccatgaacacgatcttggtgccttcaaaggcgcctatagagcagtcacttattcagactgttggaattacaaagatgggtgtgtatgttgaagccagtactggctttgggcaatctcctgagagtattcatactcactatgggattatgtcgaacaagaatgaattgttttccaccattcctgcaaagcagagaagaccagaagcaacgcaagcttacatcacaagaaacaaataccaacttcacgaagcattcaatggaagtttcatcttggagaaacttgcttacccgatctctagagggcatttgagcttggtcaacacaaatgttgatgacaacccttcagtcaccttcaattactttaaacacccgtgtgacaagcaaaacgtacacaagatgcttagcttaagcgtcaaggcaaacatcaatctaaggccaaagcaactgaacgataccaaatcaatggctcagttctgcaaagacactgttgtcacaatctggcactaccatggtggatgtcttgtgggtaaagttgtgagccctaaccgcaaagttcttggtgtcgacaggctcagagttattgatggttcaacgtttgacgagtctccaggaaccaacccgcaagctactatgatgatgatgggaagatacatgggagtcaagattcttcgggagagacttggaaacaaagctggtgtttagtttgcagattgagcttttatggtagacaaattcgtagcagataattctgttgtggaattgtgttggagaatatctctctctgtctccttctctgttatttgatattcgattcattaaagtataggatcatattgtctaatgaactgtgtaaccctctattgggcaatcggctctgttgcttattagcttgtgtgaaaagttaatcacgttttctgtttcaatactcttacaatcaattcatggcctgattttgctttc

SEQ ID NO: 9 - DNA, 5084 bp, Homo sapiens
gatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatacaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaaggtaacaacaaagagcaaatccatccccacaccctgttcactcctttgctgattggtttcgtaatcgtagctggcatgatgtgcattattgtgatgattctgacctacaaatatttacagaaacccatgtatgaagtacagtggaaggttgttgaggagataaatggaaacaattatgtttacatagacccaacacaacttccttatgatcacaaatgggagtttcccagaaacaggctgagttttgggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattagaacaaaggacagagtatgaacacctgggcttaagaaatctagtatttcatgctgggaatgagacataggccatgaaaaaaatgatccccaagtgtgaacaaaagatgctcttctgtggaccactgcatgagcttttatactaccgacctggtttttaaatagagtttgctattagagcattgaattggagagaaggcctccctagccagcacttgtatatacgcatctataaattgtccgtgttcatacatttgaggggaaaacaccataaggtttcgtttctgtatacaaccctggcattatgtccactgtgtatagaagtagattaagagccatataagtttgaaggaaacagttaataccattttttaaggaaacaatataaccacaaagcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaattttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctaggtacttcaggggcacttcattgagagttttgtcttgccatactttgtctgaaaaattcctttgtgtttctattgacttcaatgatagtaagaaaagtggttgttagttatagatgtctaggtacttcaggggcacttcattgagagttttgtcaatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattc

SEQ ID NO: 10 - DNA, 19271 bp, Homo sapiens
ccttcagttcttaaagcgctgcaattcgctgctgcagccatatttcttactctctcggggctggaagcttcctgactgaagatctctctgcacttggggttctttctagaacattttctagtcccccaacaccctttatggcgtatttctttaaaaaaatcacctaaattccataaaatatttttttaaattctatactttctcctagtgtcttcttgacacgtcctccatatttttttaaagaaagtatttggaatattttgaggcaatttttaatatttaaggaatttttctttggaatcatttttggttgacatctctgttttttgtggatcagttttttactcttccactctcttttctatattttgcccatcggggctgcggatacctggttttattattttttctttgcccaacggggccgtggatacctgccttttaattcttttttattcgcccatcggggccgcggatacctgctttttatttttttttccttagcccatcggggtatcggatacctgctgattcccttcccctctgaacccccaacactctggcccatcggggtgacggatatctgctttttaaaaattttctttttttggcccatcggggcttcggatacctgctttttttttttttatttttccttgcccatcggggcctcggatacctgctttaatttttgtttttctggcccatcggggccgcggatacctgctttgatttttttttttcatcgcccatcggtgctttttatggatgaaaaaatgttggttttgtgggttgttgcactctctggaatatctacacttttttttgctgctgatcatttggtggtgtgtgagtgtacctaccgctttggcagagaatgactctgcagttaagctaagggcgtgttcagattgtggaggaaaagtggccgccattttagacttgccgcataactcggcttagggctagtcgtttgtgctaagttaaactagggaggcaagatggatgatagcaggtcaggcagaggaagtcatgtgcattgcatgagctaaacctatctgaatgaattgatttggggcttgttaggagctttgcgtgattgttgtatcgggaggcagtaagaatcatcttttatcagtacaagggactagttaaaaatggaaggttaggaaagactaaggtgcagggcttaaaatggcgattttgacattgcggcattgctcagcatggcgggctgtgctttgttaggttgtccaaaatggcggatccagttctgtcgcagtgttcaagtggcgggaaggccacatcatgatgggcgaggctttgttaagtggttagcatggtggtggacatgtgcggtcacacaggaaaagatggcggctgaaggtcttgccgcagtgtaaaacatggcgggcctctttgtctttgctgtgtgcttttcgtgttgggttttgccgcagggacaatatggcaggcgttgtcatatgtatatcatggcttttgtcacgtggacatcatggcgggcttgccgcattgttaaagatggcgggttttgccgcctagtgccacgcagagcgggagaaaaggtgggatggacagtgctggattgctgcataacccaaccaattagaaatgggggtggaattgatcacagccaattagagcagaagatggaattagactgatgacacactgtccagctactcagcgaagacctgggtgaattagcatggcacttcgcagctgtctttagccagtcaggagaaagaagtggaggggccacgtgtatgtctcccagtgggcggtacaccaggtgttttcaaggtcttttcaaggacatttagcctttccacctctgtcccctcttatttgtcccctcctgtccagtgctgcctcttgcagtgctggatatctggctgtgtggtctgaacctccctccattcctctgtattggtgcctcacctaaggctaagtatacctccccccccaccccccaacccccccaactccccacccccaccccccaccccccacctccccacccccctacccccctacccccctacccccctctggtctgccctgcactgcactgttgccatgggcagtgctccaggcctgcttggtgtggacatggtggtgagccgtggcaaggaccagaatggatcacagatgatcgttggccaacaggtggcagaagaggaattcctgccttcctcaagaggaacacctaccccttggctaatgctggggtcggattttgatttatatttatcttttggatgtcagtcatacagtctgattttgtggtttgctagtgtttgaatttaagtcttaagtgactattatagaaatgtattaagaggctttatttgtagaattcactttaattacatttaatgagtttttgttttgagttccttaaaattccttaaagtttttagcttctcattacaaattccttaacctttttttggcagtagatagtcaaagtcaaatcatttctaatgttttaaaaatgtgctggtcattttctttgaaattgacttaactattttcctttgaagagtctgtagcacagaaacagtaaaaaatttaacttcatgacctaatgtaaaaaagagtgtttgaaggtttacacaggtccaggccttgctttgttcccatccttgatgctgcactaattgactaatcacctacttatcagacaggaaacttgaattgctgtggtctggtgtcctctattcagacttattatattggagtatttcaatttttcgttgtatcctgcctgcctagcatccagttcctccccagccctgctcccagcaaacccctagtctagccccagccctactcccaccccgccccagccctgccccagccccagtcccctaaccccccagccctagccccagtcccagtcctagttcctcagtcccgcccagcttctctcgaaagtcactctaattttcattgattcagtgctcaaaataagttgtccattgcttatcctattatactgggatattccgtttacccttggcattgctgatcttcagtactgactccttgaccattttcagttaatgcatacaatcccatttgtctgtgatctcaggacaaagaatttccttactcggtacgttgaagttagggaatgtcaattgagagctttctatcagagcattattgcccacaatttgagttacttatcattttctcgatcccctgcccttaaaggagaaaccatttctctgtcattgcttctgtagtcacagtcccaattttgagtagtgatcttttcttgtgtactgtgttggccacctaaaactctttgcattgagtaaaattctaattgccaataatcctacccattggattagacagcactctgaaccccatttgcattcagcagggggtcgcagacaacccgtcttttgttggacagttaaaatgctcagtcccaattgtcatagctttgcctattaaacaaaggcaccctactgcgctttttgctgtgcttctggagaatcctgctgttcttggacaattaaagaacaaagtagtaattgctaattgtctcacccattaatcatgaagactaccagtcgcccttgcatttgccttgaggcagcgctgactacctgagatttaagagtttcttaaattattgagtaaaatcccaattatccatagttctgttagttacactatggcctttgcaaacatctttgcataacagcagtgggactgactcattcttagagccccttcccttggaatattaatggatacaatagtaattattcatggttctgcgtaacagagaagacccacttatgtgtatgcctttatcattgctcctagatagtgtgaactacctaccaccttgcattaatatgtaaaacactaattgcccatagtcccactcattagtctaggatgtcctctttgccattgctgctgagttctgactacccaagtttccttctcttaaacagttgatatgcataattgcatatattcatggttctgtgcaataaaaatggattctcaccccatcccaccttctgtgggatgttgctaacgagtgcagattattcaataacagctcttgaacagttaatttgcacagttgcaattgtccagagtcctgtccattagaaagggactctgtatcctatttgcacgctacaatgtgggctgatcacccaaggactcttcttgtgcattgatgttcataattgtatttgtccacgatcttgtgcactaacccttccactccctttgtattccagcaggggacccttactactcaagacctctgtactaggacagtttatgtgcacaatcctaattgattagaactgagtcttttatatcaaggtccctgcatcatctttgctttacatcaagagggtgctggttacctaatgcccctcctccagaaattattgatgtgcaaaatgcaatttccctatctgctgttagtctggggtctcatcccctcatattccttttgtcttacagcagggggtacttgggactgttaatgcgcataattgcaattatggtcttttccattaaattaagatcccaactgctcacaccctcttagcattacagtagagggtgctaatcacaaggacatttcttttgtactgttaatgtgctacttgcatttgtccctcttcctgtgcactaaagaccccactcacttccctagtgttcagcagtggatgacctctagtcaagacctttgcactaggatagttaatgtgaaccatggcaactgatcacaacaatgtctttcagatcagatccattttatcctccttgttttacagcaagggatattaattacctatgttacctttccctgggactatgaatgtgcaaaattccaatgttcatggtctctccctttaaacctatattctaccccttttacattatagaaagggatgctggaaacccagagtccttctcttgggactcttaatgtgtatttctaattatccatgactcttaatgtgcatattttcaattgcctaattgatttcaattgtctaagacatttcaaatgtctaattgattagaactgagtcttttatatcaagctaatatctagcttttatatcaagctaatatcttgacttctcagcatcatagaagggggtactgatttcctaaagtctttcttgaatttctattatgcaaaattgccctgaggccgggtgtggtggctcacacctgtaatcccagcactttgggaggctgaggtgggaagatcccttactgccaggagtttgagaccagcctggccaacattaaaaaaaaaaaaaagtaagacaattgccctggaatcccatccccctcacacctccttggcaaagcagcaggagtgctaactagctagtgcttcttctcttatactgcttaaatgcgcataattagcagtagttgatgtgcccctatgttagagtagaatcccgcttccttgctccatttgcattactgcaggagcttctaactagcctgaattcactctcttggactgttaatgtgcatacttatatttgctgctgtacttttttaccatgtaaggaccccacccactgtatttacatcccagctggaagtacctactacttaagacccttagactagtaaagttagcgtgcataatcttaggtgttatatacacattttcagttgcatacagttgtgccttttatcaggactcctgtacttatcaaagcagagagtgctaatcaatattaagcccttctcttcgaactgtagatggcatgtaattgcagttgtcaatggtccttcaattagacttgggtttctgacctatcacaccctctttgctttattgcatggggtactattcacttaaggcccctttctcaaactgttaatgtgcctaatgacaattacatcagtatccttccttttgaaggacagcatggttggtgacacctaaggccccatttcttggcctcccaatatgtgtgattgtatttgtcgaggttgctatgcactagagaaggaaagtgctcccctcatccccacttttcccttccagcaggaagtgcccaccccataagacccttttatttggagagtctaggtgcacaattgtaagtgaccacaagcatgcatcttggacatttatgtgcgtaatcgcacactgctcattccatgtgaataaggtcctactctccgaccccttttgcaatacagaagggttgctgataacgcagtccccttttcttggcatgttgtgtgtgattataatcgtctgggatcctatgcactagaaaaggagggtcctctccacatacctcagtctcacctttcccttccagcagggagtgcccactccataagactctcacatttggacagtcaaggtgcgtaattgttaagtgaacacaaccatgcaccttagacatggatttgcataactacacacagctcaacctatctgaataaaatcctactctcagaccccttttgcagtacagcaggggtgctgatcaccaaggccctttttcctggcctggtatgcgtgtgattatgtttgtcccggttcctgtgtattagacatggaagcctcccctgccacactccacccccaatcttcctttcccttccggcagggagtgccctctccataagacgcttacgtttggacaatcaaggtgcacagttgtaagtgaccacaggcatacaccttggacattaatgtgcataaccactttgcccattccatctgaataaggtcctactctcagaccccttttgcagtacagcaggggtgctgatcaccaaggccccttttcttggcctgttatgtgcgtgattatatttgtctgggttcctgtgtattagacaaggaagccttccccccgcccccacccccactcccagtcttcctttcccttccagcagggagtgccccctccataagatcattacatttggacaatcaaggtgcacaattataagtgaccacagccatgcaccttggacattattggacattaatgtgcgtaactgcacatggcccatcccatctgaataaggtcctactctcagatgccctttgcagtacagcaggggtactgaatcaccaaggccctttttcttggcctgttatgtgtgtgattatatttatcccagtttctgtgtaatagacatgaaagcctcccctgccacaccccacctccaatcttcctttcccttccaccagggagtgtccactccatatacccttacatttggacaatcaaggtgcacaattgtaagtgagcataggcactcaccttggacatgaatgtgcataactgcacatggcccatcccatctgaataaggtcctactctcagaccctttttgcagtacagcaggggtgctgatcaccaaggccccttttcctggcctgttatgtgtgtgattatatttgttccagttcctgtgtaatagacatggaagcctcccctgccacactccacccccaatcttcctttcccttctggcaggaagtacccgctccataagacccttacatttggacagtcaaggtgcacaattgtatgtgaccacaaccatgcaccttggacataaatgtgtgtaactgcacatggcccatcccatctgaataaggtcctactctcagaccccttttgcagtacagtaggtgtgctgataaccaaggcccctcttcctggcctgttaacgtatgtgattatatttgtctgggttccagtgtataagacatggaagcctcccctgccccaccccaccctcaatcttcctttcccttctggcagggagtgccagctccataagaaccttacatttggacagtcaaggtgcacaattctaagtgaccgcagccatgcaccttggtcaataatgtgtgtaactgcacacggcctatctcatctgaataaggccttactctcagaccccttttgcagtacagcaggggtgctgataaccaaggcccattttcctggcctgttatgtgtgtgattatatttgtccaggtttctgtgtactagacaaggaagcctcctctgccccatcccatctacgcataatctttcttttcctcccagcagggagtgctcactccataagacccttacatttggacaatcaaggtgcacaattgtaagtgaccacaaccatgcatcttggaaatttatgtgcataactgcacatggcttatcctatttgaataaagtcctactctcagaccccctttgcagtatagctggggtgctgatcactgaggcctctttgcttggcttgtctatattcttgtgtactagataagggcaccttctcatggactccctttgcttttcaacaaggagtacccactactttttaagattcttatatttgtccaaagtacatggttttaattgaccacaacaatgtcccttggacattaatgtatgtaatcaccacatggttcatcctaattaaacaaagttctaccttctcaccctccatttgcagtataccagggttgctgaccccctaagtccccttttcttggcttgttgacatgcataattgcatttatgttggttcttgtgccctagacaaggatgccccacctcttttcaatagtgggtgcccactccttatgatctttacatttgaacagttaatgtgaataattgcagttgtccacaaccctatcacttctaggaccattatacctcttttgcattactgtggggtatactgtttccctccaaggccccttctggtggactatcaacatataattgaaattttcttttgtctttgtcagtagattaaggtcataccccatcacctttcctttgtagtacaacagggtgtcctgatcaaccaaagtcctgttgttttggactgttaatatgtgcaattacatttgctcctgatctgtgcactagataaggatcctacctactttcttagtgtttttagcaggtagtgcccactactcaagactgtcacttggaatgttcatgtgcacaaactcaattctctaagcatgttcctgtaccacctttgctttagagcagggggatgatattcactaagtgccccttcttttggacttaatatgcattaatgcaattgtccacctcttcttttagactaagagttgatctccacatattccccttgcatcaggggcatgttaattatgaatgaacccttttcttttaatattaatgtcataattgtatttgtggacctgtgtaggagaaaaagaccctatgttcctcccattaccctttggattgctgctgagaagtgttaactactcataatctcagctcttggacaattaatagcattaataacaattatcaagggcactgatcattagataagactcctgcttcctcgttgcttacatcgggggtactgacccactaaggccccttgtactgttaatgtgaatatttgcaattatatatgtctccttctggtagagtgggatattatgccctagtatcccctttgcattactgcaggggctgctgactactcaaaacttctcctgggactgttaataggcacaatggcagttatcaatggttttctccctccctgaccttgttaagcaagcgccccaccccacccttagtttcccatggcataataaagtataagcattggagtattccatgcacttgtctatcaaacagtggtccatactcccaacccttttgcattgcgccagtgtgtaaaatcacaggtagccatggtgtcatgctttatatacgaagtcttccctctctctgccccttgtgtgcccttggcccctttttacagactattgctcacaatctcaggtgtccatatttgcagctattaggtaagattgtgctgtctccctcttcccttccctctgccctgccccttttgcctctttgctgggtaatgttgaccagacaaggccctttctcttggacttaaacaattctcagttgcactttccttggtcccacccattatacatgaacccctctacttcctttcgcattgcttctgagtatgctgactacccaaagccccttctgtgttattaataaacacagtactgattgtcccatttttcagcccatcagtccaagatctccctaccactttggtgtgttggtgcagtgttgactatgaaaagcaggcctgaactaggtggataagccttcactcattttctttcatttattaatgatcctagtttcaattattgtcagattctggggacaagaaccattcttgcccacctgtgttactgctttactgtgcaaaatactgaaggcaagtcagacccagggagctggattgccatcctttattttgtgtttccagtgtacactataaaattgtctccccaggaaggaaggttggcactttctctgcattcttctttccagagcagattgcctggttaagaatctcttgttgtcccctttgtatattgttattgtaaagtgccaaatgccaggatacagccagaaaaattgcttattattattaaaaaaatttttttaagaaagacatctggattgtagggtggactcgataacctggtcattatttttttgaagccaaaatatccatttatactatgtacctggtgaccagtgtctctcattttaactgagggtggtgggtctgtggatagaacactgactcttgctattttaatatcaaagatattctagagtggaactcttaagaccagtatctttgtgtgggctttaccagcattcacttttagaaaaactacctaaattttataatcctttaatttcttcatctggagcacctgcccctacttatttcaagaagattgcagtaaaacgattaaatgagggaacatatgcagaggtgcttttaaaaagcatatgccaccttttttattaattattatataaaatgaagcatttaattatagtaataatttgaagtagtttgaagtaccacactgaggtgaggacttaaaaatgataagacgagttccctattttataagaaaaataagccaaaattaaatattcttttggatataaatttcaacagtgagatagctgcctagtggaaatgaataatatcccagccactagtgtacagggtgttttgtggcacaggattatgtaatatggaactgctcaagcaaataactagtcatcacaacagcagttctttgtaataactgaaaaagaatattgtttctcggagaaggatgtcaaaagatcggcccagctcagggagcagtttgccctactagctcctcggacagctgtaaagaagagtctctggctctttagaatactgatcccattgaagataccacgctgcatgtgtccttagtagtcatgtctccttaggctcctcttggacattctgagcatgtgagacctgaggactgcaaacagctataagaggctccaaattaatcatatctttccctttgagaatctggccaagctccagctaatctacttggatgggttgccagctatctggagaaaaagatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttg

SEQ ID NO: 11 - DNA, 863 bp, Mus musculus
gaaagcacacaccatgctggaaaggagagagaaggaaaaacccactcctagccacacaatggtggatcttaatatccaatgaaaaraaaaaaattctaatctaggtcacacacaataacccaatataaaatgaacaagacatgatcaagcaaatcaaagaaaaatgtacatcaataaatatgttaagacatgttcratgttactggtgatcaaggaatttcaaatcaagaccaaaatggtataccatttacaaccatccctctggcaaaaattaaataccaagtgtcagccatgaggtggctcagagctctcctgtattgctagtgaaatgttaactggttcaacaactatgtaagtcagcaggacattatgtcctaaaattgaacattcgtgtgccctatgacctagttactccactcaggtctatataaaagagaaaaccatgcacatatggaacatgcacagcagaaaatgtgaaagaatatctcatgctcttcagaagagcaaaaacctggaaatgaccaaaggcccatcaacagaagagtggataaattaacttcagcagatccacacaaaatatcacagcagtcagaaggaataaaccacagtgaaaaacaacaatacggttgatttttagtaatattactgttatcacttaagtcccaaaaagttacacataggaagataacttagttgcaaacacacagattttttttttttggaaattagatacagtaaaamaaaaaaaaaattaatacaagatgggagctaatgattactcctagcgaaaagtgaaagaggaaagagtaaaacagatagtggttactgccaagatcctagatttttgttggaaacagtgctcg

SEQ ID NO: 12 - DNA, 4306 bp, Mus musculus
gtgtgttcatgcgtgcgcacgtgtacccgtgcgtccacactccgccagcacgtgtgctagcttgcaagttttcagtttgagtacagacaccaggccatagcccaatggcagcagtgacagggaggaccgtggcagcatgtaacaatcagaagacaacttccggattttcactctgtcctaaaaaggtggtcaagtgtgctaaccacaccctctcagcaggatcccgcgcctcaagagccttaggtcccgccccacactccctcaaaccctcagtgcagcgcttgtgtcaggcgcaatctcgcaagatccggtgaggcgctacgtcgtgctccactcggtcccaaaagtacctgcaagcgctacacacttgcgctcggcgcccttgctctgttctcactttccgagatatccacgcatcttgagtcctgcatccactcccgggaggcggctgcggcaagcgcgtgatggaagaagagcgtgatagccagctagacaggtggccagagcggagcggacagtggagcgatggctacgtgcttgcgggacagcggaagagatggttaaagtgattgccaagcagcagaaagattcctaaaatgcttgccagctatgcggagatgaaggtgaggtttcaatgatttacatcgaccaagaacccgcagcctcggtctctcgaatcggatccgacatcatccaacacttcagtgttagaattgcaagcatgcgctctcccgacctgggcaggcacttcgaaaaaatgatgactaaagacacacgtgaagtaccaagcgaaactcacgtccttatgggacagtgactcatcacagtctaattccatcctggccaccaagcaataatgcacatttctaactggaagtcaagcaaacaccaacactttcacacttgtgcccatttctgacgagttacgtcaagtggcaaccaacacttccacttagccttgcctcagcttcgagtggcacaaggtaggaccaaccacaccctaccataatgcaccaagtgtaccctcgggcaaagcccgccaagtagctaaagcccgccaaaaaaaaaatcactgaaagaaaccactagagggcaggtcacatgacttccgccatcttagacacattcaagagcatgtgccacctctccaggctaactcagacatgaagctgacatgtgacacacaaagccctttgcgttataccgcaccaagaacttgagccgccatcttttcctgtacgacctaaatgtcctataatccattgctacacaccagaacaaagattgggctgtcgagcctcgggtggagcccccgagccgccattttatagacttctgagcagcccttaaagccacgggggaccgcgccaggggtccatatgcacacacaccctgcccaatccccacacccacgctgagccctatcccctagtcctctgcggcttccgcgcaacaccgcacactaatacgagcactccttggctttctacttccggctagcacaaccccgcaaatgctaccacaaatcaaggcgaatcccgcaaccccgcacatataaagaaagcctttagctagcgcagcgcaattggttgcttttatccagtccgctgtgctcctcggtgtcctaattcttggcgtaactggctcgagaatagccgtatcacgcagaagccataatggcggacgcgggctctccacgccctgaacacccactcagtttaagagcaaagtcgtttttctaagccataggttcactcacacagcaccaaacgatcagcagcaacagtacacgcaaataagaggcatagatattccaggtagtgcaataactcacaaaaccatatttccatccaccaagcgccccgttgggccgtgaaaaaaaaaatttaaagcaggtatccacagccccgatgggcaaaagaaaaagaaaaaaaaataataacagcaggtatccgaggccccgttgggcatgggaaaaaaagactaaacgcaggtatccgaggtcccgatggaccgagaaaggtttttttgtttttttttttttttttacaaaaagcaggtatccatggccccgatgggctaaggagaagaaaaaaagaataaaagcaggtatccacagcccagatgggcaagtttagaaaaaaaaataataagaaaaaaaaagaatgaaaaggcaggtaagtatccaaaaccccgttgggcatggaatggcggggaggacacacaggtatccgtggccccgatgggcaagaatatataaacaatgaaagaaaggtaagtccaccatacacacacaagtatcaaccaaaaggcacaacaaagaaatattccttaaaaatgaaaaattgactgaaaatattacaaatatcaaaaagtatggaggacatgtcaaaaaaaaaatcttaccagaacatatcaaaacgtcaaaaatctcgtggaattttgatatgttttcttaaataagccataaggcttggtggtaggggaactaaaaatgttcccccaaagctccttagatggagagaaaccacggaagaaccgcacatccacgggaaacgagcaaacatggctggagcaagccgttgcacgcctttaactgatccgcggcgctgaaggcggagagaccagaagaggagtggccacaaagattgcaattctgacatcttattggacctttaggtctaactatattataaaaaaattaaaatgaataaagatggaggtacgtaagctcagtgacatgacgcgtgaatttcattattttgcgcgataatgaaggattatcctattttacagctaaaaacgtttatgtagaacttccacataaacattaaataatgtacattaggtcacacacctgtctatgcaaaatttcaatatatcttctacttggacaaaccatgtatcgctccgcgtcttggacactagaagttcttctgcattagttggcgacctcagatgaggagaggaaagggtagaaatgcctcacaaaatggctccttggttcctaaattatcagagtattagttgtgaccgatttggtgggcttacgctcatagttttgggtcattggcatcttagtctttctctgggaacctggtgactccataccttgggacaaaaacgcactgaagtacgttactcgctagcagtaatgaaaaataattcctaaatgccaaagcaaagcctgagggaataatagctcattggtatcttactcgccccagagacactgctaacttaaaagaactgtcaaattttgttaactgtcaaactatgaatatccacatgaaagagatcagacaccctgggtattagaaaatcaaaggatattgttgtctcgttgattcacgctgacaaataattcacagtctgttctaagttccctttaggcgtcccatgaataataaaggacacaaaattggtttgcttatggacgatcaaagtgccagcaattcactaatcttactattgaggtggttcaggtagggatggaaaaatatctgctacaaaataaactgtttcaacaaaagaaaaacaaattaacaagtaaataaatgatgcacacagactgaataaaccagcaggtggcagcatgaatctttccaaggcatctgaagccaaacttggagtgcaaaaggattcctatctgaattgagaagtaaaggttactttgtctaactttagttgacagagcgatcaggatcagagtaacaagcacaccaaaagcatcaccagtgagaagtcacataggacatattagggaaaaaagacccaaggaagggctcttcacagctaagagcacctggctccacgatggatatggctttgtataaacgagaacttctaaatgagctgtacaaagagaatttagaacttgcgaggtactggtcacagattatgcaagccagtgtatcatttttgtggggatgctagagagaatcatcaaattaaagagttaaatttagtctctgtgttttacttagtcccaattcttgcaaacctcatcattctttctcacaccgtgtacatcaaggtatgtcaggtttcggggacactttttagtcttatcacaagaaagcatgaagggatatgtgctaaaactcagttcctgggctggagagatagctcagtggttaggagtgctgactgctcttccagagggcctgagttcaattctcaacaacttcgtagtggctcacagtcatctgtagtgggatccgatatctaacctcttctgatgtatctgaacagtgaccgacagtgtactcacattaaataaatatttttctaaaaaacacctcca

SEQ ID NO: 13 - DNA, 1315 bp, Mus musculus
ctctgcctcagaggtcttctcaagccactactgttcccaaggatgcctaattgcaatgccagcttctggggtgaacatggacccactgtcatcgggcaaggtctaggatggacatggagacccaccatctgggagattccagagtggacgtgaacccaccatcatcagagagcttcatggagtattcagaagctggcgggtgtcacctggaggatgtgactgggtaccagtgccagagcacgtgcccactgagcagtcttcttcactttcctcgatcctcatgaaacattccgggatctttacctcaaaggactccagaggctacatcattgtcttggaactggtcagtggctggagctctctccaggacaagtgcttggaggaagaacctggacaagcttccctccccatactgttgactggatcttgtagctaccgttagccaccatcatcgccattgtgtgcctcttaggagcatttccaggaggtgatgccagctggggaaagagcctctgtcccacagccgtcggtgcccgctgcagcctgcgcccaggatgtcacagcctcagctcaacacctctgctggacagcttcaggtggtgattccagctccagggttgctgcggtcaacactgggtacttgaggagaggttgtctgtgatgagttcgctttattaatgacgaatataacacagatggcctgttttcaataccacctgccactccggtcactcggcagtacataccaggtgtcacaccactgcccggcaggtgacaacgctgaattggtcctcaggagcggatgttcaaggaaccctgcctatgcaccatgctagctgccagtcctaggttgggacattccactggggacatccatgggagagctatggccattaacaagtcctgagccctgacctgaagccatcagtggcctagctgctctacctgactttgtggcctcccttcctggatctctcgcttacgacaaccgacaacaaagatgtttgactccagaagatgctccccgcggcccacctgagaggactgtccacaccccaccccactgcgccctgtgccatctacctctgagtccccaacttctcacccatgtttcaactcccaccccagagccttgtattccagatctgagcagcccttgcttaggaacctgaggtggggggtgggtaggcagacccaggggactgagcagggaggggaaggaggggtttctgctcttggctttcaaagttctcagtgtgtgtagccctttgaataataaacatatgtcatataatgtaaaaaaaaaaaaaaaaaa

SEQ ID NO: 14 - DNA, 59461 bp, Homo sapiens
aggcagaacggtcgccgcgtcgcctcagcacggacctccagggagctcctcagcaagatcctgccagggcgcccctcagcgcgattctgccggggtgcctctcagcgtggtcctccccggggctcctcagcacgattctcccggtgcgcccctcagcgcggtcctcctcggtgcgtcagtcatcgtggttctccccggcgcgcccctcggcgcggttctcctcggggctcctcagcgcggcgctcttctgggggctcctcggcgcagttctccccggggactcctcggcgccgttctcctcggggcacccggggcttttcggcgcggttctccccgggggttcttcggcgcggttgtccccgggggttcttcggcgcggttctctccgggggcctctcgccgcggttctgttctccccgggggctcctcagcatggttctcctccgcgcggtcctccctgggcctcctcagcgcggcactctcctgggggctcctcagcgcggcactctccccgggggctcctcagcgcggcactctcccggcggctcctcagtgcggttctcccagactctcctcagcgcggccctccccatctctctgggagggtttgaacacggtcagcacggacctgggcggacggcgcgggacgggtgatcactggcgttgctgaggtgagctgtgtgccccgcggccgtcccagatcacaggcgtcagcagtgcagcctggcctgggcagtgcgctcccatctgcaccttatggacagcgtggccagggtcgaggtccgagttcctggccgcgtcccaaggatcggattccgggtctatagttctcatggtggttcagagtgggctgaattgggattggagtctggaatccgcatcgtggttctgagtccgcgctattgggatggaagttgggaatccatgttgtggttttgagtcaaagcccgaattgggaccggagtcggaaatccacttagtggttctgagtcagggcccgaattaggatcggaggtgggaatccccgttgtggttctgagttaggtatcctagttgggatcagaattcgggtctagggtccacatcctggctgggagtttgcctgagttgggatctgagtagttggggtcccagtcagtccgggtctggagtccgcatggtggttttaggtagggcctcattagggacagaggatcgggagtctgagttggggacctgaatcccggtctggagtctgcatcatggctctgagttgagatccaagggaggtccgagttggcgactggagtcagggtctggagtctgtctttgggtagaggttctgaatggggggctctgagttaagagattgggattggggttagaggtctcagtggggtatgggagtcaggaattgaagtcgaagttctgcctctaggtggggattctgagtcaggaattagggggcgaagtaaaggttgcagtctgagttgggggtggtgatcacctgccaggtgagaggtagtggtagaagtctcttggtcatattggagatgagagttgatcagatgcaggtctcagtctgggtagtaggcttgaagggccaccactatgttcagatcccagtaccccactgtggtccctgagcaggtcaaatagccttttatataaaattgagagtaagagtgccttcccacagcactgttctggttatgaaagagaataattcatccaggtagaatagttctgtcttagattatcacaaagtataaaaactttcctgataatatccacatttgatgtgcatttaccagttctttctttactgtggtgccccttttgctagaccaaaagctcccaacgaggaactctgttttgttttctgctgcctgctctgtacccagccaagagcctgatacacagccttactcagtcagtacttgaaggaaagcaggcaggcaggattaaccagatttctatggtgtctcaaatgatccatttctgcacctgttttccagatactcagtaggagaaaaatttaaggattgagttgcttgattatgggtgtattttaatgtgtttcctaacatgctgaggagaaaagtgggtctgtttcaggatttatgctccagctagagggattttttaaaattgcgaatcagagcatgtccaaattcagatagaaagcacaagaaaactataaagaatttcccttatgaatgtagatgcagaagttccttgtacaatgctagctaactgaatccaataatatgtattaaacaacaattcttaaacaagtgggattgctcttaggaatgcaaagatgatccaatatcagaaactttatccatgtaattcacattaagaggctacaggagaaaaaccatatggttccctcaatagaggcagaaaaaaatgatgtgataaagtttaacgcctatgtgtgattttggggtagtggagtacaccacttagcaagccaggactagagaggaacttcttcaacttgatacaagttataaaccaaaacttaacttttcagtaaacttgatagagaaattaaaagtgtatcattctctttaagataaggagtaggccaaggatgtcatcctggccataccctaatacaagaaaaagaaatggggatgtgaggatcaggtaggaagtgataaaacttagtgtagctcatagggttgatggtctccataaagattctcaaacattttggtgttacgacttgttgtattcttaaaagttattgaaacccccaaagggcttttcttgatagagattctatctgttgatagttaccatcttagaagttaaaactaagaaatgtttaaagcagaactatacaagcacatattccactggggtcatggtgtgctgcctctggaaaactctttatctttgtgagaatgaaagaaaaggcaaataatgtcgagtattattatgaaaatgtttttgacctttcctgaaagggtctggggggctctctggaatccccagactacactttgaaaattactgggctacatggaaaaaaaaaattaaggaacttaacaactaaagagagatttcagatttcagagaggttttggatataagatcagtgtactcaaaacaaaaaacaaaaacaaaccacatttctttatgccaatagcaactgactaaaaaaaagcataatagagattaggacagcaatcagaatagcagcaaaatttataccagtctaggaattaacaaagacgacgacttttatggaaaaaattttaaaactctattggaggatatagagggagatctttccatatgcagagacattttattttcttgaacagggcaacttggcattagaatgacgtcaggattttccaaatctgttaagttcaacaggactccactcaaacttccagttggagggcttgagtaatttaacaaacatattctaaaatgtatgtggaagaaaaatatttgtaaatgccaactgaacttttgaaaaggagagcagaggacttctgctggcagataccagggcacacgccaacttcagcaatcagagcggtgtggtgacagaggcccagaagagagctcagaggtaactccaagtctagaggaaggggacatgtgataaaggtggcaccacatatcagtggggactgttcagaagatgatgttggaaagccagccctaaaatggaggaataggaatatggattcctaactgagcccctaggaaaagtagactccaaatggactaaatatttgaaagcaaaaggtagttgccatttgtttaataggagaaaaaatgaataatctccagggccagggtggccgtggggttcttaaacaggatccagaaagcacaaacctcaagactaaaatgtatgaacttgaatgcattaatgattatggattaaggatttctgttaaataaatccatcatggcaagggtcaagactgttttcataataatactaaggaaacaatttgcgtttttcacttttacactcatgaatgtaactttgccatgactcattacaagatatttgaaacaattaaagctgaggagggaacaacagctaaaatataccagaaagcaccacaaatcattaagaaaaaggtaggaagattgccagtttgcaggagggttaacaaacagatgaaaatttgcccaagctaatcagttatcagagaaatgtaaatgaaagcaacagctattcttcataggagaagcattagaaagtaggataaggccaagtgttggcagaaggcaaggaacaagcctccctgtgtgctgcaggtggggacggagacaggcacagacgttctgaagagctggccaacacttcttcctcaaataaaatattttatacctgtggcccagcagtttccctcctaagtaaacatgctggagcagttctcacccagaacaacgagaggctgtgtgtgtgcatgctcagggcagcatggcccataggggtgggcagttggagctggtcactgtggttaggagcaggggactagatgtacacttcacaagatagagacgcgtggaaacacagtgctgagtgacacaaatgccaaacagaaagagggcctcagtacatgactgtgtatttaaattaaaattacacaccacccagacacgcagtactagggagtgctcgtgagtgcacacacacacacacaatgatataaataaattaccctggagaagctgtttgtgtagggaggagagcaaggatagaggctagagatgaagtggaaaagcatggagaggaagagagcggtgactttatgcagacccttacagggtgacagtgtttcataggctgagggctgtgatcaactctgtgcagagtcccaaaagccaagaaccaacgaatgaatgtgcctccatgactctcctgccagataccctctagtggcttctatttctaggaaataaaattcaaattccatcaggtttttacaagatctgccctgcttacctctctgaccactgtcctccctcactgagctttggctctgccagccttcttcttctttgttaaatctgccaagtatccctcctgccccaaggccttcaccacctctgcctggcttgtcttttctggtgatcttcccttgacaattccttcttcttatttaaatctcacaggaaattttgctctgacctgccatatctgtcatccccttcagtcactcactagctgacgactacctttcgagtctctgcaaagcacaggctacgcttttctagttccttagacatctacttatttgttggctgcctatctcttccaccggaagagaggccccaagagagcatatctgtcttccgtatagggtccgcacatggtgggtgtgtcacagatttctgttgaatggtttcattcatttattgaacgaaggaagaggccaggccaggaaagtgtgcctccattttcacaactcagtgagaaagcaaatagcatgtcaaaatctgaccccttgcaaccagggtttcttagccagccacactggtaatgcttgggacaggatgtatctttgttgtgaggggctgtcatttatattgtaagatgtttagcaccctgcctggtctctacctagttgatattagtaattctcccatagtcatgatagccaaaaatatctccagacattgccatatgtcccctggggggcaccgcagatgacaaccacttccttagaacagctcttgggactgggatggtgtctctgctgtggctctttaaaggcagcaggccctggcttgcatcctgccacatctaacacctatagcctcaccacctcggtgagaaagaccctggcccaggcctggccaatcagagtaccctcttccctggtcagcagtataatttgtttggcaagcacttccagtcccacaacctatgggctgccacccagaggtttagttggaactacgtgtcagctgccgtccctcagccatctatggcatgggcacctgtggcttgaccaagttggaggtggcctagagaggccgggctgggcctgctcaccttctccagttagtgcagactgatgaatgagtggttctcagcggataccggatccaggtttgcagtacactccaggaggaggacgagtagggtttccctcagagcaggcctggatgggagggcaaggggtggcctctaatactgcctttccttccggtgcctttatcagcctgtgccatgctcctctgaactggccggccccagcatgtccaggttactggcaggagcctgtataacccagggttccagtcacaccagccaggaaggcccatgaggctggagcgcacccagtctctggctgctctgtctgcggaactaaaagcctttctcccagagcctttcctacggctgggcgaagctcttgtttgcaatttaaatgtggcctcatttatggaagaatccctgctcctccgaaaagccttgggctcaacctccctagcagcccgggcctcagccaggagaagaaatggatctaaaaggcctttctcctgctaattgtagcaattagcattagagaatggggactcgatggggggccagcgcctggcaaaacaagcttattcccagcttaggcccaggcccagctccacacactgctgcttggccagactcggcccccacccagggtctggttggcttcagggcagggagagagggcccaggcctgtgggtgctaagagcagttgtggagggtgtgcatctgagttgttaagcctggtagctgtacaggtagccctgggctatgacttgtggtcctctcagaaaagggtctgactggaacgcagagccagaccagatattcatgagtggatcacagagtgtagactgagggctatctggtgattgacagaaagtagtcttggggcaaatgactcttaaagagtaaggagccattcccctctatggctaactggatgcctttctctccccctgctccagaaaggacttcctgttccttcactgagcgtgcttgcttatgaggcttctggaaaccaggagagttcagtgggcctcattattgagcgtatgggcaggacaacctgcttgggacataggccatgctacagttgattttagccagcttgctgcatctacacagcacagtgccttcccaggcagtgaattatgtctaacaggcaggggaatgatcattgcctcatgttagggatgcagtcattcaagaaatatttgtcaaacactcagcaggtactagaccctggcccagagggagggatttgataggagcagggacctgcctaccctcccagggttagtggacaaaggggagaaagactaactaatgttgaaggaccgtttgcaccctgaggggagtgctgaggcctgggagcacagcaggtgtatagcaggaacccactggaactagcctggggtctgaaaaactcccttggggaaagtggcaggggcaggccaagggccctctggtggtagggagcctgtgagcacctgggatggaaagaagccaagcatctgaactaccagaaaggcagctgcaggattaagcaagacccacaggtctctaaactttgaaaggatgtctgtccactgagtagataattgattggaatggggcaggggatgtgagaatgccagttaggagatgcctgcagtacagagaaatggtggcctatcaggacagtggcaatagggatggagggaagcagggaacctctagaactatggatgggtgaagtaagcctggcttggtgatgggcttgaggtgatgggcaggtggtgaggaagcgggtgtatcggaaatgaccccagaacttctgacttgtgccactgaaaggatgggtgacactgaaaggacaggggccttcagtagagtgggctataaaatgatggaggctgtggagaggaggtgggggcaggtgactggaatgtgggtctggctgggttggagagacatttggggggtcagggcctcacaggtggtctggaagcccttggtgctgagggaacagcttagggaaatggtttgcatagagaaaggcactggcatttagtggccatgccagaagggaaaacctgccaaggagactgaggatagagccagaaagatggcaagaaagccaggagaactggagggatggaaaagaggacctaggggtcatggtcctggcagaggtcacattggatccagtgcttgtgattctctgattgctggcagtggatggccactggcctgcaaatggccctagtggaatgtcccctgcctgtgtggctccctgtgggctgcctctcccctggacagatggggagagaccccttccccacctggttctctgtttcacccttggaactgtggcggtaaagaggacctccccacagtacgtgcagggaacaagctaggttgactccctcagggaggcctcgtccttgctgaggtatttcataacctcaggatagagaaatccccccaactttaatgcaaagccaagcaagctgaaaaatggccttgaataggctgagatgaaaaaacaaagaggctgtcaacatcagagactcagtgggggcagggagcttcagtggactccccacagacagcagttcctgggcttctatgcccagacccagaggcctgagcccaagatgtcaggatgggtggtcactgtaagtgcagtggattgtagctcaggggtgagacatcgcctttttcttgtcagctctccttcctgattagtggctcaaacagccttccgagactcaaggggttaactgcagatcctctaactcctccacttgctaatttttaaacacagctgagctctgagcacccctcccaaggctgtgagaggccagaggccagcacagactctgcaccaggtctgcacagcctccacccctactgttgtcaggaatctgcaggcatctagaacaaaggtgcctccattatttccctcacccagcatatcctgatacctgagccaagagttcacccagagcttttgcccacttcattgatggtctggtgggcttttgttgacacatacccgtgactcccaaatgaacctttcaggttggcttaaagccgctgggacctacacatgacaaaacccagacggaaacagtggcttacactcctgtgtccctaaaggtacctgttcctaacagtgggagtgccagagcctggaagctggaagccaaggagacagggacctccctcctgctgaccccctgccaggccacatccacctaagggatttgggatcatactccatcttcaaccactgggatcaaatggaaagccctcaggaattctgagagacagcccctatacctatgtgcactgacacacatacactgacaaatacgcattctgacacatatatgaacatgcacatatgtgtgccccactccctgccaggaggtgggttctgtcccatctttgacatgttacttcttgtccttccctaggcccagtggcactttctttgtgataggtgctgagacccccccgactgggcccagtggctgttcccaggacccagtctctgctcttatcttaacccagctctagctcccaggaccccagcctttcgcagggagagagatagctcttttggtctggcacatgttccatgccaagtagtggaaacagcagctgcagggcagcctcagacttgacatcatttaatccttgtgacaatcctacagggaggaagacactacacatatgtgcagatgcagcaaggagcagctcagccacatggaatgacttgcttgaggtcaccaggcacttgacacagcagagtttagcccagtctctggagagaccagccttccacatcctgtcatgctggggagggctgcccgctttttgtccctgctcccccagttctaaccccggaagagcgattgtccctgctgtgccttcagcccagacagaagcaggctaggagaggggaggagaggcagggctggccctcggaaggctcaccttcctcaacagttctctgcttgggcaaaggtcttccaagcagccaggctctgaggctagtcactgtcatcgttgggtgaggcagcctgggagtaccagaagttggagcaggtgggaaccttccccagggatggggctggataggcaggggtgggtgctaagtggcaggccacaaccaggcacctgggagggccaagcaccacactgagaacgcagtgcttcccctcccctcctaggctgctcaggaacccatcagtctcctgtaaacaaatgagactaagtctctggcactctaggcccaggtgcaaaggacagctgcccctgcagctactcactctgccctggccctctcaggaggcttgtgacctctgcacctgctggcttgttttgttcctaaaatacccggatccttgagaatctagaagacaccactgctaacagatttccacatcattcattctgttcttcctgtgcaagcttcatgctgggacagggaccataaaacaaggtgacccaaaaccttcagcagaatgcaggtaggcagagcagaggtctctgggagtgtcattccaaggcagtgtcttcctcctcccctatgctccccatttcccaagagtgggcttcttccaccccactcaagcacctcttcccaaggctgacctaaaggcctcaagctctgcggataggggcagtcctgaggtggcattgagtcttagggttggagtgggagatatctgtgcaaaggctgataggaacgtcctccaagggctgacttcaaagcttggcctaaaccactgcatcaaagtcagcaagctgagctgtttgcacagaaaaggaggaggagcaggcccttgagccacctgtagctctccttagggtctcaggctttcacaccagggcaggccttgggccagactacccaacttccaggccggatgtgccaccggggaggaggaggtaactgcccctcaaaaccctgcagcccagggctccaggattccaacccagggacctgcaggctcccctgctctccagatcagacccctactctcagagccctaggcccagtgggtgacagcctgtgagacaggcctgtgtggggtggccctagccccacctcagcttccaacctgaccttgctgcatgacctctggcccagccctctccacctggagtgccatctctctttgtgggatgggccaggtgggctgtgtgtgggggagggcaagtatataggtgtggtataggtggaaactgccacagtaaccagcagcagctcagagccgggccacccaatttgtatgccagccccagctgggcctaggcacgtggtgtgtggaaatgaacgaagcaggcagccctatgtttaggaggcaggtccagagctcacccaggcacagcacaagatgagtgcctggcctcagtgagcgagcactggctgctatgaggctgtggtgtggaaccttgacactagggccactggcctggctgtgtgacctctacctcatcacccagagcagggcaaccagaggcagagcctcagtgtggtgttctcctgtgaaatagtgatggcacaggcaggggctggggcccagtgcctacacagaggatcagcaaaggatggcagttattgaaacctctacggggaagttccccagacacgagaggaagacccccatggaagctgtgtgtgtgacgtgcttagattttccagagtcttcattttccttgtctaaacagaggtcatggcgcctccctctcagatcaaacagccctgtatgagtggctacaacctttggtgggctcagtgcagcccctcctgcccccttgcttgggagctgtctgcagaggcctagggagctgcgtggggtctctccacctcagcctgtatccccacccccaccaggtcccctgcctgactccagcatacccaggccctagaagcaccaactccatggctgcagctgagtggagtgtgtgcctgcccaagcctagaggggtgctgacccctccctcgcacgaggagacatcaaagggaagcaggaagcagcggcctggctgacccacagcgggtgggagaagtgcagcctcacaactgctggggattttccatcccaccaggatttccgcgggacaccccaagtccagcctttgaggctcctcaggaaccagagtttggcctggagccagttggggcagaggaggggggccaggctgggtggcttaggggtgtggttaggcctgctaaggggctcctcttctcagtctccccatgatttgctggttactggcttgaaatctgggcccagacccattccaacactgaaccctgagctccctgagacctggctggcaaggacaggtcccaatttttacaggggcctgagaggaatggagaagggatctctgccccttcctttctcagtcacacctccttgacagggggtcatcagagtgggctgtggtaggtgcaccagggaagggaccatacagaggaggctggtctcaagtcctagggtgcctgggatggccctattgaaatgctgcagcagctcttgtgcaggcagggatctgtatggacagctgggtggacacaggtgcctactgacctcccagatccttcagcagagctcagccctgagtgacagcccaaggcagacctggctacctcagcctctggctcacagccctcagccagagccctgagaggcctgggatctcaaagctgcaaggtgggaggccagaggagagaagcccggagctggtagtgatgctggctgagtgaaaattgcacatttcccaacagtgtgatgctccctatccagcctgggcttttggcagacttctgtgctttgtggaggaagctggctcagattcctcccctccctgtgcagtttgtgtgtcaaggtgtacttgtcacacccaactcaggatatcttgcatcactttgtgggtccttgtcccccagagctgggactgctgagttttagccctaagctcttgctcccatcttagcaagtcagggcccagtgttgtccttgcctctgcatcaggatggtaagctgggcatgctccgcatcacggagacctgcatggacctggattgggttgcctctatcttcaggctggtcactgggcagacacaaaccagggcctctggccagaggggacagtggctctgagttacttgtgctgctctttaggggtgagcaggggctgcttgtgcatcatagtgtatcacaggggatgcacatttacaattgaaagctactggtcctgggtagaagtggggccgagtaggacttcccagccttgaacatgggtttgtcatccaactgggacccacacttgatccagcggccatgctctgtgcagcctgggcctgagggcagccacgctcatgtgaaaagtgctagtagccaagctgccattctagtcaccacagctgtccttgcaggagcacattgcccagggctgggagctgtcatttccgtgacgggagtgagactcaacactgggtgagggtgggggtatctgttgggaattatttcaaaacaattgtggaaacttggcagtggaggggctctgggcataggtatccacaatatcctagtcaggggttggggtaccctggctctgctgataagcccaagtgagcatactcctcccccagcttggaacaggtgggacgggccaggtgacactagtgtggtctgtggtctggcctcccaagccagtggcagtactggggtggcagacatttgctgtgtgctatcccaaggcctaaaggtcacacagctaggttggagcagggttttgggcaggatgagtaggcattgctgtgctctcagaaaggcgaagcaaaccccagaagcaagggggcgagacagggcaaaggcctacactttgccatcaactcaggcctactcaatgctggccctgtccttcccctgcccctgccccatcagatggtgcgagctggcggggcttagagtgagcccccctgactcttcttggtgtggagtctgaggcccagagtgtacaggcctcatccgtgtgacccagcaggaggatgggagagtgggcccagaacttggtcaggctcatccgtggagaacaagttcttccctagtctagttgtggtctgagtcctgggtgaagcaggaggcagcctgggaaacagcctcgttctagtaggaatcgcattctcaggaacgctgactgtgcagggccctttctcactgccacctgggaggatgcctgcctgctggccatttcggcggactgtcagagcaccctccctggggtcccagaccgaaggcctgaagtccacatgggacccctgaacttctggtacctgtgtgggcttgtcccctcaaccctgagtggaatggcaacagccagctgcaaccctcctagcttcctgtcatgtgctgtatggaagggccaagagctgtagtcatctgcagatcctcccactgcacctgtaggactagcgtctcctgtctggatgtgagcaacttgctggtggcctgtgagatgggagttgcactgggcttctggataagggcttctcgttcaggtgacaattctatgtgaaggagacccatggaaacacatctatcccctgcccatgtaccaggcagagatggtacctgcccatgtaccctccatgacatggctgggtccctgaaacatcagacagatcgatactctgtgtgcatgtttgtgggcaagacacagtggcacgtgtgccctggagtttggtaatgggaggactgaagtagtgcctccgtgtgtgagctgtgccagccatccccacgaagggggcattccatgcagatggggatcctctccaggcagcttcttccacacctgattagctctgaccatcagaccccccgtgccaaaagggccccttccctggaatctgtaattctcacaggctgtcccatacattttaaatccaggaaatgtgctcacccatgagacagggatggcaagaagatatgaatgaaaagcaaccagtccgtaaaattggaagccatttcactccttaccaggtacaaagataacatgctgcatggatcagggacacaaacttacctaccttatgatgtagtgaaagaatctaaaacttttgtctcagcagactccctggaggaagccaataacaggaggccttgactaggagacctcaagccttggaatgtgcccagaccagtggggagggaaggctgggaggcagtcctcccttaccccttttctcccaggcagacctaccctgggttctctccaggcccctccgcctgagcaagtgctcagttggccactagctccctgcacatccaacaagcctttctttcctgttccttcttcaaggaaggcttagcctcaaatccagggccacagacaaaggacagtcactctcctctgccagaaagtcatttatgggacatggagaaagcatcaaatatattgcttttccaacacctaacagtggaataggaggaatagaaggagaactcagccagaaagttctggagcatagtctttttgccaaaagaacacgttttcaaatgaaagaggtggtgctggggcactgaggaatcagggggatggaccccactggagcttgtctcatgctggcagcaagtcccaggcctcaaacacatacctgggccacctcaggagagagactgcagggaagaaatgagttgcaatgctccagcctaaccaactccccttttgttaatccaatcccagaaggtactgggtagggtcagttaacagacagctgcctgtctcctggcagagtctgaccaagccccagtgggcgcttctcttcctaagtcctctggtgtaccccattcttcaagggaaacggtccccttaagaatctatgtgaaagggttctgaaattgctgtaccagttaatgaattatttactctaaacaatgtcttgataaagggggaggatgaagttagctgatgttgactaaggagagacggagttgccaaggaaattcttctaaatgaaaaaaaaaaaaaagtaaaagcagtcagctggttttgtctgactatgaaacgtgtcacagagcatgcacctttggccatcttttgcatttatgatttggaagagagatgtagcagtgagtgtggggccagggaggggaatccaacaaagccattctgcaagctagtggctgggattttggggtatagagtaagagcagccagccttagaggcccatgtcatctgggctgcctcagagctaaagctaggtaaccagagggagtaaggaaaggcctgagtcccaggctaggcttttcacagttgtattgagatgggaaagtaagggatgttccttgcagcagatgcagggcccagttgtctagagcagtatttgaaatgagttggcatttcagggcagtgtttgtgatgccagtcagtaggtaggggcttctacctcttttttagaaatgtttactctgaactaagctctatgctttaacaagttatgttttaataggaaaactgtcattgatggaatcatatgtaattcctacatttttccagttacccattcctggggaaagcttagccattggacaaaccacccagagccccaggaacctgcatttgcagacagcagtggcaggcacagtggcctagtgttgagcgggggaaacctggcctctatgtgtctggttttgcaaactaaaacgccattgcccatactcaggctgacaggttctggaggtgccatggactcctgctctgtatctcacctctagttccatcacaatgcatgagctgtcagtgggagccttttaatgcagatgctaatacccattcctaatgctagcccatccccacaccctcctgagttggtgcgatatatcctgggaacaagaaaatctgaaggctcctggtcctcaggctagcaagagccttgcctgtaagaagtgggagaaggtcacctctctcaggaggcagaactaaggctgcacagcacaagggagatgtctgaatgcacagtctgggtggcagaaggactcctgtcctttcttccacacagacctgagcacctctccaggtgccaccattttctgtctgggaacatctgctatccccaagcctcagtttcctggtctacaaaactgagatggtctcttctatacaaggccccaggaggatcactgcaagtcactgcatttcatggtgcccagatttccctgcatttctagaatgtcaacagagatgagtgggctcaaggggaagagattctttatgactagagatattctggtcaactttggaccccagcttctatggacaatagcatgtggacatgagccctggggaagcagggatgactgagcctgaagaagagctctcaagccttacactctccagaccagccttgggttgcctgaaccccagcatagccttatggaacccctgccagggtcctagcacctggtttgacctgggcacaagtactcactcactcactcactcactcactcactcgtcaaacattcactgagggtccgtgacaggctccatatggattaagcactgaagataaaacactgaatagaaacagccagcctataccctcatgctccttgaatgtgatagaaggagccagccagtaaaccctttaccacaaataaacacacagttacacattaagaatgggaggggaggtatgtgattttttacagcccagtcttaagctttagaaattggctcctctgaggaagggacatttcagctaagaaccacaggataagacagtcctggcctggggaaggggagagaaggtcaggagagagcttgatatgtttaatactgaaagaatatttgatgagctgggacatctcctgcagatccacggctccctagctttgtgaccctgggccctagactcaatccctcaacccttaggagattatctataaaacaggagtgataatattcttgtgttaaaagctgctgtgaggattagtgaaatgatgtctatatttgcctggcaaacaggaagtgtaagtagtagtatcatttgaagattattcttcagcctaaacgtgtgttcattatggccggtgtgttttctccccacctagatggtagtgctgggcctcctttggagtaccttgatgtttggggagcatggatgatatgaccataacctgagaaggcagggactgtacccattctggtcctcccaggtcccagggcccccacagtgccctggtgtgtgatcagtgcccacaatactgaatagaggaacagacacatgggaagcaacggcagcctggtctttaagggtgagggagcaccttctcctgagagagggagagataggttgggggaggttgggtgggggtggggagagcgagtgagcaagcaagctagaaacttcctgaaaagggaagttactctagaaaagggtaagttccttccaggcatcatgggctggcttaacctggaccagtttgactttactaagtcccatttctcatctagggagcctgaggccattaaggttatctggtcccaaaatcccctagagctgtcacagggatccccattctttgcctttagtcaccccagccccaagagccatcctccacatggagtgagcagggagctacaaggaaaagacggtcacagttggagagagacagagaaccaggtgggctggtaggacaggaaggtatagggagaaagtgaagctctctcctggggaggcaggaatactctcctgcttccttctacccactcttcatagaacacaaacactgcaaaaatgactttttccaaaccctcttagcattcagaagtagaattgctatgtaagaattttttcataggtgcttttttggggggcatctatttaaaaaataaccacatcattagtgaaatcttccaaagtctctttttggagcccacatttcactaatgtccacatctgaggaggctttcataataaaagaacacatacctatttcacctatgatggtcagtgcaatcttgaaaacactagtaaatagtgtccatcagctttaaaaatacaaacccaaattgggtcataccaaaatgcaaggatacacacaataacctgggtgaatcttcagggaattgtgctgagtgaaaagagccgatcccaaaaaggtgatttgctatgtggttccatttatataattttcttggaatgataaagaaatgaagaataggttagtagttgtcaggggctaaggacagggtagggtgggagggaattgggggtagctataaaagggggacatgagggattcttgaagagttagaaatgtcctgtagtgagactatcaatgcaatatcctggtcagaatattgtactacagttttgcaagatgttactatcgggggagactaggtaaaggagtatgtaagatttctctgtgttgtttcttagaactgcatgagaaatgtacaattatctcaaaataaaaatttattttaaaaaatgcccaaattaaaaaaaaatcagtagtcctcctaaaaatacccagaaatgaattttagaatgtccaaaatccatacaaagatctaaaaaaatatggaaggatgttgcaatggatttgaacatgtgggtaaactgcttctatttgtggctggaaagactttttttttgaggtggggaaggcaattcttcatcagttaatctaaattgaatgaagtttcaataacaaatgccaatgggatatgaatatacacacagatagacaactttttttttttttttttttttaattaggcaagctgaggccaggtgcattggctcacgcccgtaatcccagcactttaggaggctgaggcgggcagatcacttgaggtcaggagtttgagaccagcctggccaacatggtgaaaccctgtctctaataaaaaaaaaaattagccagtcatggtggcagatgtctgtagtcccagctactagggaggctaaggcaggagaattgcttgaacccaggaggtagaggttgcagtaagccgagactgtgccactgcattcccgcctaggtgacaaagtgagactctgcctcaaaaaaaataaaaataaaaaaaaaattaggcgtgctagttctaagtttatatgaaaaaaatgcatgtcctataaaattcagaagtagcagcagtctggccccttgtgctcctctagccctcaactggcctaacaggccctagtgtgcagcagggactattttcccatcatcactgtccacagcatctggacaagaatacagagaacggctgatttaaaaaaaatctaatctgggatcctatgcatcctaaataatcttatgaggatgcacttgtattttttctgatgctgatactattcattccaactcgcctccccatcagctttgtcaggcactgtgaattgcatggtacacatgattacaatggatggaatggccatcatgaggtatagcaatacatttaagtaacactgtgtcactactataggacaggcacttttctgcatactttatattattaatttgtgtaatcctcctaacaaccctctgaggaaggtactcttatgattcccattttacaaataaagaaactgagactaagtgactcactcaaggtgtagcaggtagaaagtagtggaattaggatatgagttcagactccagaccctgttattagcccctgtctttggctatggattagtaaaggagagcacagccaagggtgggacaggcagctgtagtcctctggaccagcttcacatggatggggctgcattgttacaggtggcctaactcagacatggaaactgagtcgctgctgcccaactcatgccatgaaaccattttggcctgcacagcttataacagcactctagctctagctatgacactttatggtgttagtgggtttttttggtggttggtatggaggaggggctgggctacaagttttagattatgtttcttattgcgggtttttaaaaattcttgaattaggcctatttgctcttttgttctctattgagttagcaaattcagtttttccaagatgccctgaaagtatgatcatacatgtatacgaaatggtccttgggtccagctggcaactcctgtgcacccccgacctggattctgccttccttgaagtgagccttggaagaaacaagtgctcatgctccctgacattattagctgccacgatgaagcctcagtcccaaacaccccagcttcctgtctaactcaagagctaatcctgtgtttaaatcttaagagtgtttagatcttaggccatgccatgaattcccctggttgactgcatttgtgaaaatgagcttcccattattggctcttaagtaatggagatgagggggagtcctgctacacagataagtgcatcataaagttacataattaaaataactgagctctggcctatcaacaggcccatcagcagtccagaatagagtctagaaatggacacaaattaaatgagagtttgaaatatgataaaggtagcagttgaaattagtagagagatgatgatgtactcaaataaatagtgttggacaactggacaaatatatgggaaaccaaattggatttaattactctgtcaaaatcccgataaagcaaggatttaaatgtaaaaaatgaaataaaaaatgatagaagaaaacatggaagaatttattaaaacaatttcaggatgagaggttatttcagaatttaagataaggacctcaaaccataaaagactgacacagctgactatgtgaaattaaaaaaattctgccaccagaaaaatattatagaaaaagccaaaacacctaaggaaaatgaggataaaatattttcaatgaatatgacaaagcaagtttctacaaatcagtaagacaaggtattttacaaagtccaaagggtatgaagaaatagttcacaagaaagaaaaacaaatgattttaagcatttggaaagataaaaacctcatttccaacaaaagaaatgtaaattaaagctccagtgtaccatttctcatctatgaaatgaatgaagataaaaacctgagtatacacttggtaagggtgggggaagaaagtgcatttgtgcagtcaaagtgatgtaaatggtacagcccttatttggcagtatctatcacaacataaatgaacattttaatcctgctggaaatggggggaaagggaggatctcttaaagtaaatccactgaaaacggagaccaaaattttacaatagagatatttgattgggaagttaatttgaaaaataacagtagttaaaatattattttatctcatatgcaataacagttgttagagttacaattatgtacacgttttagaaaaaaacaaatccagaggggattttggtttgtcttttgtaaagcattatatggtaacatctgagggcatcttttatacttggcagaggatgttggcagcacttccacagagaggatcattttttgtagaagtatggcatggtttcactgcttgaccaagaggccacctgcatcaattatcatctcccctgctgtcctctgaaatgcttatctaggcatcgatcttggtttcctcttcaactgattaactaactggtctactctgcccagtctctatttgagaaatcatttgacatcattttctttaacttgatgaaatctcctattttgacaagatttacagttcctctttataagttcctctttactttgtgtgtgctttatattgtctttggttgacaagagacagccaaagaggtcagtcagcagagatacaagtagggataagatggatagggagaaacaacagtgttcaatagggagggatgtttcagggaaactaatttcataagtggtcatttcagtagtgaatatatttgaatggttaatggctgctgttttttagctgccctacatatccatcaacagaggatctgttccataaatcatggcacaatgaaactctgcagctgttaatgaaaaggagatttgctagatgtcttaatacagatccatctccagaacataccagtgtcttccttttaagtggtgcacactggggctgaacacttactaagaaatgaaagggctccccagtcaaagctgacaggtgtcattacaacatgacccctgtggtagatcccagcacaatacactggccatcactccattctcttcaaatgtcctagggttgcttcatacagcagaccatcgtacccaaagccactatgcatatgacttggttatctcctgccaggctgtagtccagttagtgctcccttggaaatactcaagaccttaatgaactatctatctgtgaatctgtgaagctacccatttcttagaggcctctttggagagctggctgttgaatacccagtatgatggtccttagccttcttagacctttcctgtaccactacctctatgccttttgccaagtccaagtgttcaccagaaatggaactgatgccagaaagactacagctaacaatctgagcagaacagtgagcatgtcctatctgggaaaagcccagcccattgggctaaatctctagctgaacacagagactatgctccttccaattatactggaagcccaaccatgagaaaacagcacttcaactacactgttcagagccatcacctgttcacacgtgtgtctgtatacatgtaaacacacattttgcaataaaaatgcttctcagatgtactgcaccataataaatcagcattgtatgtacagctcaaaaagaagtatggcatacctatggaagaagtcaaaggcaaagtgtagaaaaatacatacagtatgctaccatttgtataaaaaggagccgtatctactaagtacatgcacacacagacacacgtatatttgtttatataaaatacgtctggaaagatgcaataggaaagtgttgagtggtaacctttagggaaggaaacttgggaattagggttgggtggggagagtgttatttttcaccccttttgtactctgaattggttttaccatgtgtgtaaagactgttgtatgatttttgtagcacaacccttgaatacataaagcacgattggctccccagaaggcaggtgttggccaggcagtggatgcacggtagggcagtgtgcagccctgcatgcacgtggctggtatgccctgcgggcagcagctccccgcacacagtgctgtgagtctctggttcatgtcactctgtggagcaggggctgctccagcacaaagaggtttttgacagggaaaggcagagccagagtcagggcaggccctgggcgggctcctagagagcccaaccaccctctaataaggggtgctctccaccctatctgaggagcaattgggatctcctaggaagtgaaactgttacgtatgtcttattacagaatttccagtggagtgattctggaagaaatgtgtatggcatgttgtgactgctatgtctcatgaaatatttacgtttttatgtaacttttttccattttcagatcatcttttattttaacgcaaaatgacaatatatttttcaattaatttgcccaatatctgtgtttaaatgttttctaatgcacacacgtgttttaaactcattaaaaaaatatgacttagatcccatcccactttcatgttttatattgccaaaactctgcttttgggagaggtgagttatcttcacttctgaaacagtactgcttgggagctggtttggccctggctattctggggaaatgacacaatattgacctagaggggccctaatctttccccgctagagcactacctctaatagggtgaaggatgggagaaagaggctagtgaacccaccttcaggtctgtccactcaggacatgcccacactagcctctccaggggctctgcccttggcatccccgtcccccacctgggctctggcagagaagtcaggcgggaagaagccggctgagtgcccgccactgtaagaggaaacgaagagaaacagctccagtcagccccagaagcgaggcctggaaaaactctgcagctggagctaacacaaaggacttttcagaccctgcagccaaggtgcccagtgagcttttttttttttttttttttttttttttaaaaaacagctattagggtgacaagcctttccaaaggccagcagttggcgagagtttccaggaagctggtctggcactgggctgggattggagcaactttaacgagttaagttcagaaggaaggagtcatcaggaaaggtttaaggttcaacaaacttttcaaattattttgcaaaaagttctggctttccaattcaaaggcatgtttcgctgtgactgttttaagccagagcctatttaaaaggcaacacaactagcatgcttcagattcactcactcgaggtatttgtctaaatcctccgaatgggctttgcaagtgccatctagtgcctagtaacactggggccatcttacacatctcgacaggcagccctcctccccacgtgcctccccccagcctctgtggtcgtgtgcgcgcgggcgcgcacacacacacgcacgcatgcaccttccctaagcaggaagctgctctttgccaagagcgaatggaattcagatttccagagggtgtccttggcctccagctctacggctgcatgatgaagaaaggtcctagtgtgtgtgccgggggctgggagagaggggcctccagctctgctcacatctatctgggccccaagaaaaacccacaactggctgtgctctccccagccacacccagccttggtcacattccttcccttcctgagcccacactgggtggccccggcaaaccagcttccacacctccctccccaccggcagggagacctagcccaagcccccatggggcagccagcaagtacaaatgaggggctgcaccccaggcccaaagagccagaaagcacggagggccctccccccaccccacccccaatgctgggcatccccttgtggctgctgtcactcatggggaaagagacacactcccttgtctagcacccggtgagctgagctcccatcccttcctgtgcctgctttcaggaagtccctcttcatatccaaccttgactctcctggctgtggtgcttgtgggcctgggattgaagggccatcactgccctttgcaccagagcttcccaacataccagcaagaagggactgtaccccttcccctgtccagtctgggccttccaagccctgagattcagcaacctcaggaattaaacatttataggaaaacacctatgcagacaagggacatgagtcagggtggtcatcagcagtagcaaggtgggtaggctggtcacgtttagcttctctttagcccaagtaatagggtcttccacctgcatggccagggaggggataggctgagagcaatctttctacaggctgtcagcatcaacaagtggttgtgatgagcaggagtctgtatggcttttcaggtgttccggctcaaggaggcccaacaccaagttggaacctccaggcctggtgcctaggcagaaggtgggctaaacaaaggccaaggggagctctgctctgtcacttccctttgtttgctaatgagactgtttccaaaagctggcctggtagcctgtgggattgtttctctcaagatttcttctaggggagaaggtggctgaggctttgcagtctgcatcacccagtccccagaatctacaggggactcagcttgcctagtcacagttcggcttttggccttggctccagggcccattctgatcctcgtgcttgggtcagggatggtcagcacccctgccctgatgctgcctgctggggtctcctgctgagtaccgtgaaggcctactgtggcctgagaagccaacttcactgtcccttttggccagccctagaccctatatttgttcaagtaacacattgattcactggcttctcctttaggcaaggcctgcaggggactcagctggggttcatgattccttgccacctgtggtgggcctgcatggccagcccaaggcctcaagtgccacatactgctcccctgacagtcaggtggctagggtatgacactcaagaaaatgcccaggcagaacccagagttggggtcacttggtccagcccttctgaaggggactggttggatctgttgcggggaggagacaggccatgctggaccagcaaaaaagcatagaacttggagtctggaacctgacatctggccttggctctgccatcagctggctgtgtccactgggcaaggtcctatcatatctggtctcagtgcttccatttacccagagtccttccatcacctgacacctacagggatgctttcccaatcaaaattcaggccatgtggtttgataaggccaccttccaatgtggaagacaggctggtaatggagaggcctgggagcacagagctcctaggcactgccatggaatgtggggaccttagggaaggatatctcaattgaagctcttcagagcccctggggtggactgttctgtactctcatcccctaacccataccagcctgagctcaatcatatcagcctgtgaaggctgccccaccacactgcttctgcacccaccacaccaggcccccttgagctcccacctggagcccacacacccagctggtggggttcgtggggcagttcaaaaagaaaagcagaaaaaagcatttgagtattttggactggaaggaattcaatttaacttaacaaatcaggacatgaacctaaagaaaacactgaaaaacaagcccaactttgaaaggcccaaagagggaggattaggtgggagaagaaaggtcccctgtgggcagaagacagctgctcagtccagaccagggaccaggggaggatactgggcttgagtgcagaccgggccagggtagggagacaagcccaacatacactcgaggacttgaagtcaggggtgctagctgactttttagcccactctttctaccccagatacagagactagctgcctgaggaagcatagcggggcccacaggctggctgcctggtgctgcccacctcctctccagggcttggctccctggggcagaaggctcagacctataaccacagtggggttgcagggatttatttgggggaagaaccctgactgggtcagaatgattatgtgcatgcatgtatgtgtatgtagctccttgttctctgaaaagccttgcctaccaccctacttcccaagtaccctctattgccttgcaaagtcacccctgctctctgcctcagtttccccagcagggcaccacaggacactgctgtggcaaggtttatacttagggtgcagtgcagtctgatcttgtataaatgctcagtgccaaagacttaggagataagtcaggcagagtcaaaattaacctttgaaaaatcccttgaattggccctaaaaataatccctttctcagatctttgtgtatatcccctgctgggttgctcttctgcctgctaaagtgggagaatctctgggtgcacatccagagtaccctgggagaggcatgccaggtgttcctgtacctttttcaggatattcccagtgtcatcttcagagggagcctctgaggctgcagccacacatgggaaaagattacttatggagaagatcagaggctaaggggctggggatggtggggacatcggattttgaggtcagacctggactcctgtctacctctgtctctctaccttttatttttctttccttttctcctaacaaggccctatttctaagatggcacctcaggcctcccatgggaccaaccaggcctgacagactaactgctcagactaactgccagacttcctcctgctagccagtcactaccaaggatgtgtgcctcagatacagcccctgcccaggacacctacgttgtccctaacagggcccacatatctaaagcatgaatgcctagccaggggctctggggcaccataagaaggcatgaagctgggcctgccaatttgcatcctgggagggcaggtcagccttgtccaggcaatccaggaggcttcccagtggcccactggccagtgaggacctttgacctccttggctggtggcaccaggtttatgatgcacatagaggctgaacttgaagaattcttattgcagagggcagccacaagagccactggccagtgcccagataatatctgcagactgttccctcctgctccatgggccacagaatccctttgtcttgttactgctacactgccttcctaccaatcttcagggttcatcctggcctctgccatgcatatccaggctcccccagagattgtgtgtctgggaatgagccctggcttctgctcctatctcccagtgatactggcaagtccctatccttcttgaggcttcaatttccccttctgtgagctgggaggacaggcccactagatgctctctgagggacctaccaaggatgtgggctgtgtgtctcagccaacagcagtatctcctaaccccaacacaagaaatacacatagtaggtgtctggttaatgctcttggaatttcagcctatactaaccatctgaaagccactgagtctgaactctgctaccatatttgagattatctctccattgggcacctatgggttgcctagagacaagctaccatggtcctcttccctcgcccgtcatgtgcagggtcaaaggcaggtgagctacacagctcgccctgctcttcactctgctttaatgtgggtgcttgccttggcagatgggcccgacagtgataagaacaaatgacagatgcatactggggcacctgtgactgccatgagacacagtccactgattctgcctccaaccccctccccagagcagaatagtgagtgctaggtttccgcctgtacctccacgggaccccaacagctcctgaaccccattccgagatttgaggttgtgacttggggacctctagacttcccttccctccacctgactccagactgtcctggagcttgggactctcaggcctctaggcacatcttattaaggacagcagctgacagccatatgttgtgaccccatttgtatcccatggtaactcatgacctggcagtctcaaaagctctcaggccaaataaggaatgtccccacaggatctcccatcacaaagagacattctatgctggctaatattttcaggcatttccccgagtcaggtatgtggctggatgcctaacaccatctcctcaaggccttacactaatactgtgagatatactcccaatgtatacaagaggaaactgaggctgatagagattaggtgactgccccagtgtcctgtgggcaggatgaaatgacccaagctggccagggctccctgacagaccttgtccctggattcagcgaacatacatcaaaccattagctgacaaggaatgaatctgacaagctgttcatgaccaccacactgaaaactacagggcaaggtaaaagatatgaaagtcaacctaaataaacaagggacacatgatgccatgtttcaggagccccaaaactataaggatacccattctcccatgcccatctagaggctgctgcgcctagaggaggctttccatggcaactggcatatgtatggtgaggagaaaccctgcaaagacagcaaagccagtgatggggaaggagaagcagccagagccagcaggaccagctgtcaaaacctgttagcaaactacagtgagaaggaagcaaggtcctggccacaaagaacaacttgaatctgaccagtggcacccaatagggtccagaaacagagccacacgtagccagtgagctgattgtaaagacactgatacggcagggtagttgggagaggacgggccttcccatgccgggtgctgagctagactggatatccaagtaggggaagagtggaccttgacctcggcctcacattggacacaaaaatcaatcccagatggagtgcagatctacatgggaaaggtgagctaataaagctttagaataaaccagaatatctttatgaccttggagtagtcaaagtttcttaaataggacacaaacagccctatccagagaggaaatgtttgattaactggaccacatgaaaattaagaccttctgttcatcaaaagacaccatcaagagaggaagaaggcagcctgcagagggggaggcgatatttgcaatgtgtgtgtctgtgagagagtgtgagtgtgtgtatctctctctctgacaaatgactccagaatatctaaagatatataggaccataaataaacataaaacaggcagaagatgtaggcaatttatacagaatgatgtatctgactaaatgataacatggaaagggactcaacttcattagtcaacaggttactgcaaattaaaatcaccatttgatgctgctagacattcaccatcatggctgaaaaggaaacgacggaaaatgccaagtgttaggatgtggagcagccagaatgctgcctgtgggaatgaaaattggaatgactcctttggtagactgctgggtagtattcactaagagtaaacatatgcccacccaggaccctgcagctccacacataggcatatattccccagaaacgcaacctgatgctcaccaaaagcatgtacagaatattcttaaacagcaacctacaccagaaactgcctgctggccacaggtggtagaatggatgaatgatgtaggccatgcacacaatggagcaccagtcagcaaggagcatgagggagcactctcccttcagccccatagagaggctgccagacatcaaattgagtgagggacattggacacaaaggtgtatgagttgcatcattcccaccgcataaagttcaaatgtgggcaaagctggtccttgctgctagcagttaggcctgtggttaatctcaaggtcagtgacaggaaatgggagcctgagaggctttctgggggttctgttgcttcctccgggtgctgcacacatgggtcccagggactgaagatgcctcaagctgcgcacttgagacctgtgtactaatctgtgtgcatgcacattaccctttaactaaaagtttaacaccaccaccctataccagggtagcccaggtgagcctaattaggtggatagccctggccttcagggccgctaggcccagccccatcccactccctcacttaaggggacacggcttccagacttcctgactaggtcacctccgtgcttcagcctccagaggctctgcagttcaatctcccctttcaggtatcagcagagcacacaagagatctatatgggatgtgccccccgcccaaccccgccccgaccccctgccccaactgccagaagtgtctccatgacaatatcagtgcagttgtgaagtcctttgccctccagccacctctgtggcgtgaatgttctctctgtcacatcctccaacaccatctgcttggctgaggacctgagcagcatcatggctgggagttcacaagtggagagggctgagcctggccagagtgcactggggcagggtgatttggatggcctttcccttgcagaggaaatgagaagcctcactgctttcttctgggccatccacctagacagtgcggccctctccccatagcagcagccctaggccagccgcttcttcctcacgtgctcagacggaggaagtgaagtttggaaaggttagggggccacggggggccgccacagctgggctgatggcaggctggaagccagattgagggcatctgattcccaatcccatctctttcccactgagccattacgcctcggttttaatttaattagaagaacatttaatccccccgtgcatttcagagacgggtttgagcctggctggggctatgtggggctctgacggggatcctatgactcatgcagccctgtacagccctcccgggcgggcccccagagggcttccttggcatctcgtgcagacagaggtggtctggagctttgcagaagacaggacactggtctagaaagacaaaatggtctcatctgttcttgacaagcccctcactcatccttctggacactggttcccagaatgtcctttctgtcctttcccaccaaagtttacagggagagaaatatggtgaggagcttagacactcacagagctgcagtgcctggtaccctggggtctgtgggagtaggtcacagtggacctggatgtctccaaaatgtcccaggccaagctggtcccatcaaaagagctagccccttggtccatgaagccaaatttggggccacccttgtgacgtttgcccttatttccagacagcacagactggccctgtccttgctgacaaatgcagaattcaggagacattagtagtgatgtggatgaaagccaggccacagcggccttgctggaaaagagcaactcgaatgtcttggcgtgagattctgcagggtccaggagaaagttgaagacatggaaattctaattaacgcacacggggctgtttttgctcaaggatttgcgaagctgtcatgtcacaagaggccaggcaagcacatgcttgccagggaggtgctcacagtcacctggtgggggtctctgcagctttccctctgccttctttccaccccctctgcccagcctcgggggtcctggtcctcccccatgcccatctcaatgggccgggtgctccctgagtgtccctctggagagtgggactgagggcggtatctgttaacctcgagctggggcttgcccatctaagatgccaaaacagaagagacaggggcccttcagagaaaccacatgactgggctgggcagagccataggctgcagggcttatgggcctgtcctcttgggccgtctatctcaggtatccatgtgcaaccaatggggcagacgtgtgaattccaggccagtcctggctggcttggcagttggggatgcagtgtgagggaggatttcacaaaaatgatttcagcctcccagggttgcttggagaagctcacccaggccacacctgcacacagcccccaagttcagagccgcagatcctcaggcccctagccctgtgcctcagcactggcacaatgtgtctgcagtccttgcttcatcttaggcagggttgagtgagcagcaatcctagggcttctccatgcctggggctttgggggttctggggaggaagagaccaagagggctatacatgcccttctccctcctggcaccattcgaaaggcttagggaactggtactgagggctttgagagccaaaggaggacacagccgtacagcctaagtgtgtcctggggggtttactgagcagacgttggaaagatgaatggaaatctggtggctgcagatgggtgacaagggcattctagatggcaggttaccacacgcaaggcacagggatgcacacaggcatggcaccgtccccacccactgtcgtgccagtgacccttggtgagcagaggatagtgagtgggtcagaatcccaggaactcatcctggctcttggggtacagggctcctcttgtcatgggggtgctccccaactgcccatgcaggcctacagtctctacttcccacctttctctcagaagccctgtcatatggttctgggtgggagacacaggctcagggagtttgaggctggcagggactctcttgtgccccattcaacctaggaagacagcttctgcctgaaaggtgtgttcgaggctgagtcctggccgcccagagctggttgagggtcctgaggctgagcagtagggcccacctataggctggggtgcagcgacgccactctttatctcctgggtaccccgtgcctcagcttgtcatgactccctagcttgcatcaggcctgctcaccccccaccccacctctggctaacaggccccggaaagaggagcttcgcccagccccagggaccttcccgtaatcaaggctatagtgacctcacctctctggggccctgcgggcggggagagctcgagatggaaacaaaatgtgtctttatttatgtttttaatttgaattctggaactggcccagcatggtaatacatttaacatcagtagaatgctgaagaaaaatggaaatgttttttggtaactgcctcccacccactctgccccctgtgagaccccagcacacatccctgtccctcacacacaccagggcgtgtgcctctcttcccagttcagggtccatggggccaggctgcccacaggagcttcgctgcatccctgagcagctggagccgaatttaattatgggcatcactgggcgggctgtgcaggaggtggaggaatgcagccccaatgcgggcagaagacctgcacggcccccacacccctgccgccaggcggtttgggccctgaggaaacagggtgcccactgctgccagccttctcccccagatggagtggggcctctacccagcctgtatcccagaggagcctgggttcctaggccctgacactgtacgtgcccactctccccttcaggcctctctggagggaccgtaccctgacttctgaggatgcaggaacccagctcccctgaagcctcagccctgagtcttccctgaccagaacacaatgcctcaaggtggcccctttgcagcaacctccttgtttttccctctcccagtcccctcttcagatccctcaccccaagccccatgcctgggctccttcctgccttcccaggctggctcatatctagcagccacttttggaacagcctgctctgagagaggccttggtaagttacagggcagggacctggttgggtaatgactggagtctctgacctgcctgggcccacttatcactggaggccatgggagtgccaacctgaaaaggctgcaggatcttgcagaatggtaatgtgccagacccaaagtgggcagagagcttggggatggatgttcaggtctctcaggccctgtcatcctggagtggaacaagaaacagcccagtgtcctagatgacacagccacactggcttggggtcacccttgggcaggtgggtaacctctggctccagggagcttggcatgtgctgataccagcactggcagccctcacccccatagtggtgatttactgggcagctgcaagtttggctgtgatccacataagtgcctggtctctcaccaccttcacctgcaggggccttgcaagacccaagagttggtaaggcctggctgcccagctagatggactgtgggtgatggccctctcctcccagtaggactttttgcatgtctggatgctggtccgtgaccaagagaaccaaggtgagcgagagctccaacaggagaagcaagcagccagaaggatgagaagggacagtcccctctctgaggggacagccaagaggcaatacaggcactgccacctgtattgcacacaacatgagccactaaactaacactgatcactttggaggtccatcatatccaggacttggtacaggccttggccacagtgtaagccatcattctgccttctggtgctgacctgtacctgggcagcccatctggctaccagcctgctcacacctctgctcctgcctttttacccagccaggaggggcccagaagctcagagccctattctcagggtgtccatgactagtcacccctgctttccagtgatctgctggctcccttggagcctcttcacaccctacccaccatgaggtactgccaacctctctgtgaactgggggggcctggaaagacagtgggcaggtcctgtctgatcataattaccccttaagatagccactccttccctggaggtggcctcattctggctacccaaccctgccagttctctggttacacctgcagcccccagcaccatgggtcccgatttcctcagtgatttgcaaggccaggccttgcacctggctggctgcaaaggcaggaggcccagggcctcactacgacaaagacacacatggctcaggacaacctcctgacccccagagagtccaaagaacaaaacaccctttagaaaaatgttggtagagagaaggagagtttccacaagtgaccctcagaagggccgcgagtgtcactcacagatcttgacacaaagacatttatcaaggggaatccccaacgggttagcagccagaatgggactgtggccagaatggacttgggtgccccactgaccccgctgcacggctgtcaccgctgggcaccccagcggggagtcacatgtcgcaggggaatcacaccgtggccgggcaccggggattggcctggccatgccgtgacggcgggggaggacgggcatgcatcccaggccagctgtgcctcaggggaaggccaactggaaggcgtggaaaatcagccatttcctccacctgaaggagcccctgaggacagcagcagcaactggcagactgcacccggcatctgccccatggctttggccagggttccatggggaaatgctaaaaaacaaagtcgtctcttttttggggggcaggggagggggctgggggagagaaaaacaatctcagactctcaaagcatgaaaacaagtggaaaatgatcagtctggttttccataagtcaaaacaagaggatcatgttcccaggctcagtgggaagtgcccttgctctcctctcttgcctggtgcctccgtgttggggccaggcagacggcaagtggtgggcactaggcgagtagatagcactctggccagagagcaaggcttccccagcaccaagtctgactccttgagctccagtcccctccagcccagcccttcacgcacatgtaggcactcactgtgagatgtgggtgatgggtgtcagcagagtctccccttccaggtccaggtcctcggcgaagctgttggttctcatgaaatggggcatgctcacttccagcagtgttgggctcttccttactgaggagaaagtgtggggacagcacgttaggcctcccacccaacctgccagtgctgtggagccaggcctgtgagctcccagggccaggtgaggagtggagcttgtgcctggaagctccagccctgacaatcagttttatagttgggtgttggggtgggtgggtgtttaagatggccccaaagtgcctgacacctcagtgtctgaggagaataaaggccagtgaatcatcttcggagtggtaactgtgcctggggctgtgctcaggtgtccaagactctccccacctcaggttctgggcctcttcccatgttcacaactgacacttgggtcaagaataaaacagaggtgacaggcacaggcctggtaagggacaacagctcccaccaccatacattgtcacactcatacattgacagagtagtgggtcaggaaagatggggtgataggacctctgacccatgaggaatggcaagcctgggaggtgggggcagccacagaactccttcctcaaaacacgatgctacatcaaccagttgtacccccaatgaggcacaggagtccctccaacagctggcttcacattatgattcctgggcccacctctgcaactttgacacaggagctcaggatactgatccttatcactccccactctctgttgacactatcagtatttgctcttggcttatatttgtcttcatttaaatattttattgcaaaaggattaagtactcatctgtgagaagtggaataattcaaagattcacaatggctttcctcccccaaggtcatcagtgttaactgccaactagatccctagcccaccctctctgctcatccgagcagcagatgccaggtgggagttgcttttatgcacatgggatgtcactgtgactctgttcctgtcactctgtaacataagctcatttcatttttctctaggtatataggcatggatttaattattttagtcattacataatagtccacagtttagattggccacagctaaccattctgtatatcatggacattcaggctcttatagttttaagctgcttaattattcagactatgatgccatattcatctttattcttaaaagctgacatactggagcagggtgagagggtgtgtccttagtaattttaataaatgttgctagattgctttcccaagaagttgtagcaattcaggctcccccagctttcccacatccatgcctgaatgaagtgttgaatgaagcccgaatgaaggttgtcagcaccttttgcagggactatcaagcatggatgaaaactgaggcattgctgttatttccatctgtgttgaataccttttatgggcttggcatctgtttgggtttcctcttgcagaattgcctgttcatgtcctttgctcacttttgcttatcactttgtaggaattttctatacattacagacattaactccttgttatatgaggcatagatagcttccccagtctgttttttcacctgaattatgttgcttttatcctagaaaatgttttatgtttttaaagtgatacatcttttgctttataaaaaaggaaggttttcccacatcagcgtaatacaattctctcttaaatttattcctaatttcactatttgaatgtgttgtatgtatacatatgtatgtgtgtaaaagttttaatgcatttagtatctatgcctgataggacagatgatcaacaattagaaaatgaaaatttaaagggtactacatacaaacttactgaaaaaaaatctaaaataaaacataaaaccataaaatatcttgaagaaaacataagagaaaatctccaggaccttggatttggcagtgaattctgaaatacgaaaccaaaagtttaactcgtaagagaaaaagaatcaacaaattggactttatcaaaattaaaagcttttgctgtgcaacagacactgctaatggaatgaaaagacaaagcacagacttggaaagaatatttgcatatcacctatcaggtcaaggacttgcactcagaatatataaagaatgcttacaacttgacaataaagtgaacaatccaattttaaaaatggattataaataagcacatgaaaagatacataattaacataaatatggaaatgcaaattagaatcacaatgaaattccataaattaaaaaaaaaattcaaaacctgacaataccaaccactcttgaggatgtggaacatgtagaactctcatatgttactggtgggaatgcaaaatggcacagtgactttaggaaatagtttagcaatttcttattaagttaaacatacacataccacatgacctatcggttcctttcccacccaagtgaattgaatttttatgttcgcaaaaacctgtacataaatgtgtatagtaactctgctcataattaccaaatactggaaacaatgaagatgtccttcaacaggtgaatgcataaacaaaatgtatatattcatgcaatggaataccacccagcaataaaaagaaattaactaatgatttatgcaacaacatggatgaatctcaaatgcattttgctaagcagtgaaagaagccagatgcaaaagaatacatattataggatcccatttataggacattctagaaaaacaaaactacagggacataaaacagatcaatagctgccagtggttaggggagaagtacttgacttcaaaagactcaccccagggtatttttaggggtatggaacttctgtgaatgatactggattgtggacacatgactccagacatctgtcaaaacccacagaactgaatctcaaagagtggattttactgtatgcaaatttaaaaaattaacccggatgttggaggaccctacgatgaaaagcagactatgatgagcgtgttacaaacaaatgacatagcagtgaaaggaaaggaggaggaggagctggcatatgttgctttcaaaaacactgttttgactggacactctatggttaaagcaaaagtctgtcctaaacactctaatctagtaggtaaatttgcttcacatagggtactacgtgtacaatagggttacacaaataagtaaatgaactgtaggtaatgggagccaggtttctagctgtcagagaaaaagctataaataagttgtgggggagggggcaaggatgaactctggtcagaaatgtcagtatgaactcatggttagctttatatagatacagatatgtaaagatgtatgtgtactcaggttacatacatacatatatttcctagctctgtccactgagaggagactgaagcaatgataccctagtagccacgagcataccccgtgcctagatccaggttttctattcattctccagggagccagggctctctggatgaatggatgattctagggctagggtagggaaaataaaagatgagcctgaagtattgtcaagtgctagaaaagaaatgcttaaaaataaatgaaaaggatggcggggggcacatcaaaaggacacatgaacccaccagtggccacagcttgaacaatttgagcaacaaaataaataatattggactataactcaaaaaataaatactcccaaatccacactgataaaattaaataaacaattggaggagagggacaaatcttccttataaaggaattccaaataaaaaatgtagaaggaatgaggaaaatagaagtacatcacggtaatatttgctgcaggaaaacgatccatgaatgaatgctgaaattagttagtgaaactcagaaacttcacagtttcttccttgaaatgtattttaattgctgtggtagttttaacatatttgcagattttttttgatactctcctgcaggaggtagagttgaacccctcccttccccaccttgagtgtgggctatacttagtgactcgcttctaaagactaagctatggaaagggaaaaacagctattcacttacagtggaggagcctggccgacaccactttaaacgagtggctcaaggttaatattaccagtgataaaccatgttgatgtcatgttccacaatgaggaaagcatctcacctcactggcctccttcccctaaacctataaccctggtctagtcctgagaaaacaccagacaaatccaaactgagggacaatgacacctgactggtattcttcaaaagtgtcaagttaatgaagaacaagactgagaagcccgtcaccgatcagagatgacaataaatgtaatgatcgatcctagatgggatcttggaacagaaaaaggacattagtagttaaactggggaaatccaaataaatttataactctagcttaatagtgtaccaatgttaattttttagttttggtcaatgtaccatggttatataagatgctaacattaggggaagctggtgaaagggatgtgggtactcggtactatttttgtttctcttctgtaaataaaaaatgtgaggtaacaagagaaaacagaacctgtatacaatagcacaaaagaatattaattatctaactaagtatatgcaagaactctggagaaaattgtaaaactttagtaagagacaatgaagaagatataaatggagaaatatgccttcattccaatgactagaagactcaatactgaaaagattatctcaaaatctgaataaatctctccaaatcttaataaaaatctcaaggcttctgtgtgagaactttggcaagctgattctaactgcgacttggaagtgcaaaaagccaagaattggcaatattcttgaagaagaacaaggtgggagaacttgctgtaccaaacatcagtacttcttccaaggcagtggtcattagggcaatgtggtattgacacagggagagacaaataggccaatgggacaggattgagcattgggaaacagcccacacaaatatggaagcttgctgtgtatcagaggtggcctgcacatcctgggaagagcatggacttttcaatcaaatgttcaggagcagttggatacccacactggaaaaacattaagttggacccttaattacctcacatcatataccaaaaattcattcttgtcattctaggggattgaagacctaactatgaaaagcataactataaaggtcacatgactgaatatagaagaatatcttaatgacatcagcattaggatggttttttttaaaagaagcaataaccatgagagagaagactgagtaatttgacattagagttaagacccaatcatcaaaatacaccttaaagagtgaaaagacagtgcccacaaaatgcaaaggactcctacaaatcaataggaaaaatataaatgacttaatagaaaatgggcaatagacaaagtagcacatcacaaaagaggaatccaaaaggctgatgagcatgtggaaaggtgttgcgcctgactagcaatcagggaaatgtaaataaactcaggagctcatggcccgtgggggcgagtggcagacttccagcaggaaaccacacagacattacttagtcacagccaggagaagggctcagagtgaaagggctctgtgcccatgacatccttagagagaccagggaaggacctgtaaggcttgaagaatgtgcagatttggagacccacaggtctgggacctggcagaagcatgttactgcccccattttagagatttggggctgagattcaagtaccctaggttatataatgcagttgtcaagtgacagagctaaaacttcatccaggattcaattttttttaaaggaaggaagaaagaaaaaacatattttgatgtttgcatcacttgtatgtagaaggaacgatggagcacaggctagaacgtagagttgctttccaaacacccatgatgacaagtgcccatctccaaagcctgagggccaagggtgagccacctgacccctgaggaaggttctgtcctggtgttttaggaaattaaaatgtgcacatcagttggctgcccagagtgggtgggacctgcacctgccagagaggaatgtgtgctttttggtttaatcctgggaacggcatatggggcccctataacaaggggcagagaaggcctccacagatttgtttttccaattcaagaggagaggttattgtctgctggcttgtgtgttggagactgtggggcgtgctttctccaccacagggaggcagtgaccagagctgccacctcttccctgttttcacctgtggtcgtagccaggtcaggcatctaggagagcatggaggggagctgggggtgggtgggtggggattcagctctttccagacacactggtgctgcctctttcaggccagggcttgagggcaagtgctgtgccctaacaggtcttgcttgtcacccccacctctgaagtgggtatttcacagcctgaactcacagctgcagagaaggttgagcccatggtgtacttgaaagggcagttcatctggatatccaggctctgcaggaggtaccggagcaatgccaggtgccctttgctgaactgcctagagtggctggccctggggacaaagagcacagcatcctggtgacaatgaagtcacactttcctaagacagtcctggtttttgatgctttaattctttggctgcctttgctttgtcaaggccaggatctgggcctaaattttcagggcagaacaaaacaattttgttttctaggaaagtgggaggtctgggatggcaaaggcagcctcgggcgtggcgactaccccagctggggacgctggctgccaagtctcaccctctcaagagaacaggaatcaaactcagcacagcatcctcctttctagtcagtggtcctgctcgatagggggatttgaattttatttttttaaaaatacaggcacagaaaaaagactagaaggaaacagatccaaatgttaactttgtctttgggtgattttcatttccttccttattgtgtctgtgttttctattttgcatgatacttttccaagtcaagaaacaataatttgtggaagtctcctgtatctgtgccttgctctctggcccacgaccttgcacatcttatcctagagttgccagaatatgtccctccacctggcctggagctgcccatgaggctacatagagctctcctatcatgaaagtctttgaggctttctgttcccaagaaattctggtctcacttcctctgccttctcatcgagccccagacccctccctgcccagattaggtcagcattcaagccccaagtccagcctatgacaaagctcaaagctccagcccatctctgctgccctctgccctcaagagactctcgccagtgtctgggcccttcctagtaacttcacccaaccactcaccccctgcccttcccctcctgattgattaaaatccggcctaatctcccaggtgtaacccaagccctcttccacaagctttccagggctccggagattgccccctcccctgtacggctgcagggcttatgtgtgcctggcgctcagcacgggaaccttgccttctgcctcacccatgtctccccagggtttggcacaggcgagttccctgagccagcctacttcacaaggatgaacagaagctctccctatcctttgcaagtagaagccccctccctggccccctcaagaaatctccccctctcagtggattcaccaaagccctgcggatcctgcactgtgaaggagaagccctccccaggggcatccggacagctgcagccaggccctgcgtgacattgctgagccgcagccccacagcctgtgccagctgcccatgcccggctcatagaccctgagccagagtggccccgccaccacctgtgtctccactcagaggcgagaagtaagggacatggatggaaagtgtaaaagccattcccacaacagctgccaggaacaaggcgaggaatggagtgaaaatgtatattcacagctggcacccagttccgcttaggaaaataccttgcttgagtggacacctgttgtttttgcctgccagcagccaggcctggcttctgggaacagcttctcaaatcttccttagggggctcttcctttcccactcctagtgtgcagtgtttaggtaccctctggccatccccaaaggggtccctgtggaccttgcctcagccatcggaggtacagctgcaggtccaaggatggcttgtaccccagctgaggccaataagaacctggccttagattctggcaggaatcctggaagagatgacctcgttctgctgggcttcctgagctgttgaatgcaagctggtggccattttgccccttttagaaagtagctgcctaaggatacagccatcccatggggccaatggatagagagcaagggaaagggagaacaaaagagggaacgggaagggagaaggggagtgcaagaggggagagtgagagcaagtgagcaagatcatctcagctctggggtccagctgtgtctgaaacagctgggtccagctgtgtgagccaaaaaatgtcccttttgtgcttaagcttgtttgagttggggttccatcatttgttaccaagagagtcttcaggaatgtgcatgacaaagttgggggtgaggtgtgagcctacggacatgggcctgggggcagtcaaggttacaaaatagctaaactggtctgcactgcccccactagttttcagggcagagggcagggagaaggcttgtgggaaagaagctggcctgaggccaaggccctggccctagccctgcaacagcacagggaactcttggaaagggatttcctaaggtgggacattggctttctactgctgtgatgcaagtcctcatctccccaaaccttcagtgagcctctctccacaccctgctgtatgaggatgtttgatgcaaattatggaacatgttggatctcacattggatcaaaggtgtgcagaatagatttgcctcaagcatgacagtgatgtgacacagtcaaagatgacttccggaatcctgagaagtcccagggaggatgctgggctttccaaaacctaagtttaggatactgaggaccacaccccacaccccaaacacttctccttagaataagtatagcaagcctcagcatacacaaatctcagagtgaacggaaatgtctctgcaggcccaagggtggggtctgagtagcgggggcgctgaggaagacaggcagtgacagagccaggacagggtcaaccctgagcgtgagtgagcccaggaaacggaaagagagcaacacagccacccacacaactaaaatcgacccacccgggtctccatgctgcaggaagtcactgtctaggtctcccaagacacattttcaggggaaggttccaggcagcaagagcagccctaggaaactttaatatacaatggaatctgggttaagcactatcttctccaagagttgagctcacaggacattccccagaaacctctggagaggtggggaggaaagtttctggaggtctttggatggagaaaacaaaaaagtggccttgattttcaagacaaaattacacaggaagaaaaaaatgtttttaatctaattaagagcgatcttttcaccttcatcacaacatcgcggaaatgtgccagttcttaacttcacacaataatcaaagcaattagtgagggagaagccttggaaaccggtgcagatgttctcagaatgtttaatggggaaatgagttgcaggcctcattctcagcatccggctccaggccctggctaccaaatccagacatctgctggggccccacccccaggccccgagggcgcgggcttgagaaacacaggtcccttcccaggccacctcccagccaggccagaactggggccgagaggctccccatagcttctcaaattggagcctggacacagtcagagccaccccagaactggggggaggctcaacatcaaaattatgttaacaactgatgtcaaaagtaatcaactcagcttggctcccccactgctgctggctgcaggagggctgtgagtaggaggagagcaagcggccccagagggaccctcggctatgaccccctcagcctgaacactacttcaagaaaagatgtggtggcatctgtctggtatggtcctgtgggctccattccaatgctaatggactcttaaggggcccaggaatcaaaatggtcaacacttgaggaatttccagtaatcagagaaaacgtatagaaatgaggatgatgcttacttaggaaatggcctattacaggaaacagagggccacgtggctaatgtcagtgagctgtgggagagacagagaccccaggtggggcaggcagatcagcaaatcttggaggacctgctatgtggcaggcactggagacatggaggtaaagaacacaatatccatgttctcagggacacactcatatgcccttagcattcacgttcttcacactgacagcttcttaatgcaagcccaccagatactttcataagcactacctctgacttcaggcacttgctgagctgcacacagggcaggccaaaaggaatggaaagtgagccaccaccggggcagcactcactagtgaaagataaataccccagctctctcagccgcttgtagaactctgaggagtgttctgtgcagcttcccagctgcccaccatgaagctctttctcaataagtgaccagcacagcttaattcctgaattaagctgtgtgtgctgtgagactgacacaagacagggtgacaggaagctgtcggaacatttgagtagggaagcagcaagatccactgtacatttaaagaactcccttgagctgttatgtgaagaatggagtacaggaagcaagagtggaaatcaagagaccagtaatgaggtatggacaacaatgtaggcagagaaatggtggtggttttaaccagggagatagctggagagactaggtgtgggcaaatccagagagttgataagacatactgatagattagaaaggggtactaagaaaaaaggataatttaaaaaagactttcagccaggcttggagaaaaatagcatgctgctcctcatcccctctgactataaatcatctcactcatcctcccctaaaagcataaaatcagtaagtgcaaataaaaccacatgacccatgctgttagcagtattaggagaaagaataccttcaaattgcctgtgggtagcaaagtgagccaaattccaatagcattctagtcccctgcccagcactgcaaaactgcatacagaatcagagaagaggcttaaaatgctttgtcaaaaagtttgaaggtagttagcaacatcagcaaaaatagaggagtaagtacctctaaggagccttcttgccttcacagacatcctaagcaccaagcagcctaagccactgatgaacttgcagataccactgatgtggattatagtctaattaattgtagagacaccacacttctgcactgaaccagaaccaaagccaaagcaccctacccaaatgatactacagacgcgtgtacaggaaaagtccttactaaggctactccataaaattggaagtctctgttattccagatatgcagatatcaacttggggacacaaaaaacttggggggaaaaaaacaagaaaacatgacttgccaaaagaacacaataattctccaataatagactccaaagtaaaggaaatcttaaggaaacccaatgagatacaagagaacacaaatagacaatacaaacatatcaggaaaacaattcattatctaaatgggaaatccagcagagttagatatgaaaaagaaccaaacaaaaatcctggaggtgataaattaaatgaatgaaataaaaaatacaattgaaagcttcaaaagccggctaagtcaagcagaagaaataatttctaaatttgaagacaggtgttttgcaataaaccagacagatttaaaaaataacaataaaaaagaatgaagaatgcctgcgtgacatatgagacactattaagctaacaatatttcacattttgggagttccagaagaagtgttgggataaggaccagaaaatctatttaagaagataatacctgaaaactgccaaagtttgggagagaaagagactaacagataaaggaagctcacaaatccctaaatagattcaaccctaaaagggcctctctgaggcacattttcatcaaactgtcaaaaatcaaagagagaatttaaaaaacaagagagaagcatgaagtcacatataagggaatcaacagcagattaacagatttttcagcagaaaccttctaggccaggaaagaattgaatgccatattaaaagtgctgcaaggtggggaaaagctcacaaaattgctagccacaaatactatacccagcaaagctatccttcagaaatgaagcagaatgagggaagaaattttgcctccctcagacaagcaaaaactgagggaattcattactactaaatcagccccacaagaaatgcttaagggagtactacatctggaagtaggaggatgatatctaccatcatgaaactacaaaagcataaaacactagtagagcagatacacaaatgagaaaggaaaaggaataaaagattatcactacagaaaaccaaaaaattgcaaagaaaaacaatgagaggaaacaaaagtatacaaatcagtcagaaaacaataaaatgacaggagtaagtcctcacctattgataacaatcttgaatgtaggtaatttaaatttcccaaatgaaagatagatactggctaaatgaattaaaaaaataaaacccaattacatgctgcctataagaaactgacttcacctgtaaagacacccatagactgtaagggaatggatagaaaaagatattccacacaaacagacaccaaaagcatgcaggagtagacagacaaaaaatactgagtcaaaaaaaaaaaaaaaaaaaaaaagaaaaagaaaaaagagacaaaggaggtcattatataattataaatggatcaattcagcaagaagatataacaattatatatgcaaccaacaacactggagtacccaggtatattaaacaaatattattagtgctaaagagatagaccccaatacaataatagttagggatggcaacatttcatactcagcattggacaattcatttggatggaaaaatatcaacaaggaaatattagatttgaactgctgcttcgttagcacacagcacattctccaggatataccatatgttaggacacaaaacgggtctcaataaatttttaaaagtcaaaatcttatcaagtatcttctcagaccacaatggaataaaactggaaatcaataacaagaggaacttctgaaattgaacagatacacggaaatcaaactacatgttcctgaatgaccactgtgtctatgaagaaattgattttaaaaatttaaaaattctttgaaacaaatgaaaatagaaacacagcatacaaaaatgtatagggtacaacaaaagaagtgctatgagggacatttatttcaataaacacccacatcaataaggtagaaagtttttaaacaaataacctaataaacgcatctcaaggaactagaaaagcaagaacaaatcaaacctaaaattagaaggaaataaatagtaaagatcagagcagatctaaatgaaatagagataaaaggtaaaaaagacaaaagatcaatgaaatgaggcctcccccccaccccccgagacacggtctcactctgtcacccaggctagagcgcagtggtgtgatcttggctcactgtaacctctgcttcctgggctcaagcaatcctcctgcctcagcttctgagtagatgtgcagcaccacacctcgctaatttttttttttttttttggtagagatgggggtttgccatgttgctcaggctggtctcaaactcctggactcaagcgatcggcctgccttggccttccaaagtactgggtttacaggtgtgagccaacaaacccagccaaaaaactgattttttgaaaagagaaaatcaataaaccattagctagactaaccaagaagacccaataaataaaatcagaaatgaaaaaggagacttacaatggacaccacagaaatacaaaagattattagagaccattatgaacaactatatgtcaacaattagaaaacctagaggaaagagataaattcctggacatatataacctcccaagattgaaccaggaagaaaaaaaatctgaacagagcaataacaaggaatgagattgtatcagtaataaagtctcccagtaaagaaaacctcaggattgcacgggttttctactgaattctaccaaacctttaaagaactaacatgaattcttctcagacaattccaaaagactgaagagaaaggaattctccctaactcattctgtgaggcaagcagtatcttgataccaaaaccagataaggacacaataacagcaaaaaagaaaactacaggccaatctccctgatgaacatagatgcagaatcctcagaaacaaaacacacacacagacacacaaactagcaatctgaatccaatcgcacatcaaaaagataatacaccataatcaagtgggatttatcccagggattcaaggatggttcaacatatacaaatcaataaatgtgatacatcacattaacagaaggaaggacaaaaaaatacatgatcatctcaatagatgcagaaaaagcatctgataaaattcaaaatctcttcatgataaaaaaaaaagctcatcacataatgtctagaaggaacataactcaatgaaggtcatatatgacaaacccacagccacctggggaaaagctaaacaccttctctcttagaactagaacaagacaaggatgcccactttcactattcttattcagcagagtaagaaaagtcctcaccagaacaattaggcaagtaaaagaaaaagggtatccaaattggaaaagagaatgtcatattgtcctttgcagatggcataatcttatacatagaaaaacctaaagattccaccaaaatcttttagaactggtaaaggaattcaataaagttgcaggataaaaaaatcaacaaacaaaaattagtaggtgtggacatgatggctcatgcttgtaatttcagcactttgaaaggatgaggcgggtggattgcttgagcccaggagtttgagactgtcctgggcaacatggcaaaacctcatcagtacaaaaatgagctgggcgtggtggcctgcacctgaagttcagctactcaggaggctgagatgggaggatcacttgaacctcggaggtgaaggttgcagtgagcagaaattgcaccattgcaccccagcctgggcaacagagtgagaccctgtctgcactcccctgcctcccccaaaaaatcagtagcatttctgtgaaacagcaaattagccaaaagagaaatgaagaaagcaatcccatttgcaatagctacaaaaaaaagcaaagcttaaccaaggaggtgaaagatttccacaatgaaaactataaaatactgataacagtaattgaagaggctacaaaattttttgagacatcccatgctcatggattgaaagaaaaatgttaaaatgatcatatttacctatagcaatatacagatgctatgaaatccctatccagatatcagcaggggcttcaagatggctgactagaggcatctggcactcacctcctccacaaaatatagcaagtaggtaaccacagtttatatagatcgcctctgagagaatgctggaattcaactgagaagtaataagaaaaacccaatgcaagggataagaggggagtcaggcagtctgcttctatgggactggctgggatcatgaagagactcctcgatgtgcagaaaggtaagtaagtgagcccctagtggtccacattcccacagcagactcctgaaatcctagtcagagaaccccctgacccatagatgccttgagactaacaagaggctacctacagactgtgaaatggcaatgaacagctcccagagagggagatcaccctgaatcctcaggcaattcacacatcccctgaatcctcaggcaacttcaggaaagtcccattttgatagcccaacccccaccagactgcatctgctgtgggccccacatccctctatctcatccctggagccccatggacatcccttacacaaagctggttgccactcctgactgctccctccaggccaaagcatgagccattggcaatactctgctacctccgaagcaaggctgccatgaggaaaggtgaccctgcccatagtcaccacctggggccgaagcatgcattgcccaactgcctgtttatagctgctgccactgaaagcaatcccactcaacttccccaggagtagggctgcaatagagttgctgctgccccaacatgagcattcagcagggtatacagggatcttcctgtgcctgcctaccacagtcagtacattcttgcattactggagggcctcaggacaggcccacctggcctggtcccaccctcttttctcccagtgccagcgcataccatctctgggcctagggatcaccctgccctatccagtattgttggcacctgagcactcctgggggcttgaggactgccctacccaactgaccattaccaccacaactggcattcacttgaatttgccacctgtgggccttgggacaagctcatccagcttatcccagccatcccaataccagcatggacaccttgggaggcagaagattgttctgccactgctactgccattgcccaagccatatctgctgctcagagctcaaggacctacccaccctgtggcccagctctgtcatcattggcacctgagcaagttgcctggaggcccaaaattggtttccctggacttgctaacactggtaccagcatacactaccattgggcccaaggataagcattcggggccagccactgctgccactggggcctgaggactggcccagctggtgtccctatccccagccagactttaccacagcctccaccaacaactgcatcctaaactacagaggaactcccagacactactggtgctgtttacagctgaaaaaaattccatggagatcacactactgcaggcacccagaatcaaaaccaaagtgccctgcccaaagaacaccatagatatatcttcaggaacaagactctcttaggaaagacagatcaaaaaattggaagaaactactgttacaccagatgtgcagataccagtgtaagcacacaagaaacatgaaaaggcaaaacatgacaactcctaaggaatgcaataattctccaacagattccagtgaaaaagaaattgatgaaaccttgaaaaattcaatataatattaaagaagatctgatagactatacaaagaaatcagaaaaaacaattcggggtatgaatgagaaatttgcccaagagatagatataaaaagaaccaaacagatattctggaattgaataatagattgaatgaaataaaaaacatatttgaaagcttcaataacagaccacaacaagcagaagaaagaatttcacaccttgaagataagtcttttgaaatgactcagacaaaaatatagaaaaaatagaaaagaatgaacaaaggctatgtgactataggatgccataaggtgacaccttcagtgtcccagaaggtgaagagcaaaccaaaagattataaaacctatttaatgaaataatacctgaacacttcccaatctcccaagagatttagatccaaatataggaatctcagaaccctaaatagatacaattcagaaaggtcttttccacagcacattatagcaaattgcccatcccaagacaaagagagaatcataaaaccagcgataaaagaggttgtagacacttacaagggaacaacctgcagactaacagatttttcagcagaaactttacaggccaggaggatgggattatatacgcagagtgctgaaagaaaaaacaaaaccaaaaacctgccagccaggaatactgtacttagcaaagttatattcgtcagaaatgaaggagaaataaagtatttcccttaaaagtaaaagctcagggaattaattgccactacactggcactacaaaaaatgcttaagggagtcttacaggaagaagtgaaaggacaacttcatgaaagcacacaaaataatcagaaatcaattaatgacaggaataagccctcacatatcaacaataaccttgcatataaatagattaaactttctacttaaaagacagactggctgaatggacttaaaaacatgacccatctaaatgctatctacaagaaacgcatctcacctgtaaagacacatagttgaaagaaaggaatgggaaaagatattacatgcaaaaggaaacaaaaaccaaacaggagtagctatactttcatcagataaaacaaaggttaagctaaaaacactaaaaagagacgaagtcattatatagtgacagagggatcaattgaccaagaggatataacaattctaaacatatatgcacccaacaccaaagcacccagatatataaggcaaacatcaaatctgaagggaaaggtagacttcaacacaataatcttgggaacttcaattctccatttccagtattagacagatcatctagacaaaaaattaacaaagaaacattggatttaaactgcactttataccaaatggacctaacagacatttacagaccagttcataaaacagctgcagaatatacactcttctcatcagtacatggaacactctccaggatacattatatgttaggacactaagtatgattttaaatatatatatattttaaattggattcatatcacatatcttctcagaccacaatagcataaaactataaataaataagaggagcattcaaaactgtataaataaatggaaattaacatgttcctgaatgaccaatgggtcaaagaagaaattaaggcagaaataaaaaatttactgaaacaagtgaaaatagaagcacaacattctgaaacttaagggatactgcaaaagcaatgctaagaggaaagtttattgtaataaatgcctccattaaaaaaggtagaaaagatcttaaataatctaatgatacacctgaaggaaccagaaaagcaagaacaaaccatactaaacataaaattagtagaaggaaagaaataacgaagatcagagcagaactaaacaagaaactaaataaatataaaggatcaatgaaatgcaaaatcggtttttgaaaagaaacaaaataaccagtggctaaactatccaagaagaaaagagagaagacctacatgaataaaatcaaaaatgaaaaaggggatattacaactcataccatgaaatacaaaaatcaaaactcttcagtctgatcaataaattgattacagttacaggatttaaaaatcaggcttatttctatataccaataaagaaccagctgagaaagaaatcaagaaggcattatcttttacaaccactacaaaaaatctaggaatgagtttaaccaaagaggtgagaaacctctaacaaggaaaactacaaaagtctgatgaaagaaattgaaaagaacacacaaaaaacatcccattctcatggattgggagaattaacaaaattaaaatgaccatactacccaaagcaatctacagattcaatgcagtctctctcaaaataccaatgccatttttcatggaaatagaaaaaatcctaaaattcagatggaaccaaaaaagagctggaatagccacagcaattctgagcaaaaataacaaagttggatgcatcacactgcctgatttaaaaatataaggctatagcattaaaagcagcatggtattggaataaaaactgatagaccaatggaacagagtagaacctggaagtaaatccatgtatttacagccaactgatttttgacaaagatgccaagaacatacactgggaaaagagcaccctcttcacttaatggagctgggaaaataagatatccatgtgaaaaatgaaaccgtttctatctcttgctatactaaaatcaactcaagatgggttaaagacttaaacatgaggcatgaaactataacatcactattaatgaaggagacattggggaaacactttaggacattggtctagggaaagattttatggataagacctcaaaaacacagacaaaaacaaaaatagacaaatgggactatattaaatgataaagcttgtacacaacaagggaaacaatcaccagagtgaagagacagcctgttgaatgggagaaaatatttgcaaactactcatctgacaaggtactaataccagaatatactaggaactccaataactcaatagtaaacaacaaattaattccaataaaaagtgagcaaaagacatggatagatatttctcaaaagaaaacatacaagtagccaacaggtatatttaaaaaaaaaagcccaacatcagtaattataagggaaatgcaagccaaaaccatagtgagaatggctattttaaaaagacaaaaattaaccaatgctggagaggatgtggagggaactcttatacactgttggtgggaatgtaaattaatactatagaaaacagtttgatttctgaaaaacctaaaaagagaaatatgacataatccagcaatctcactactggatatttatctaaaggaaaagatatcagtatactaaaaatgtacctgcatccccgtgtttattgcagcactattcacaacagcaaagatatggactcaggaacctaagtgtacatcagtggataaatggaaaaagaaaatgaggtaaatatatacaatggaatactaattgaccaaagaagaatgaaatcatgtcctttgcagcaacatgaatggagctggaggtcattattttaagccaggcacagaaagataattatcttatgttattatcatatgtgggagctataaaagttgatctcatggaggtagagagtagaaggatagataccaaaggctgtgaaaggtatgtctggagggtgaagagaggttggttagtgggtaaaaatacacagctagttagaataaataatttataatgtttgataagagttggttgactatatttaacaatataatgtatatttcaaaataaaaaagaggacttgaaatgttcctaactatagagatgataaattgagggtgatggataccctgacttgatcattacacattcgatgcatgtaacaatagcacatgtaccccataagtattatgtatcggtcaaaaaaaaaaaaaaaaggaaatcccagtgctttggggggcc

SEQ ID NO: 15 - DNA, 1811 bp, Mus musculus
gacagagcacagaattgcttctaaagtcagcccggcgcagttgcaatagacagcaaaaaggtaaacgtttgcctgaaatccgcacgccagcttcaccaccccgcccgatggttaaacagtgaccaaggggagatagagaggttatcaccatgcaaactgtgccaaggttctgtaacaatcaagaacacgtggacacctacctgtgggaggaggcttgggggaaacactgtttctggttgctgctgaagccagcattctggagatggacagctgctcaaggaaatgaagggagattttgtaaattgcagattctaagcaggacaagaactgttgcttccctgagttggcctgcttttccagagtatcttaaaaggtctcttgaaacaaataaaatactcagaacttctgggactgtcacagacagtgtcctgttactggctttaaacagtccctcatgaggaagaagccctatatcctgaagtcagatgtcaatcatcctgggaagactcaaccaagaatacatgcttagaagaaaactgtttcaagcatccccatttacgtggatgtatctgcacagtcctccctttccacaaacaccaacactgaagccccgatgctgggaggctctgaattaagaccctggagaagaactgccaaggggatttacttttaaggaagcccatgatcctataagagtgatcatcagtgtaaatcaaatcaaacgacttggatgctctctccggctctcaatctccaacacccagaagaggtgtcatatggcggttttttcctctgcaccacatcttccaactatgatgtctatcatcaaaaagtccagagcaatgagacagataccaccataactcataaagagaaagcatgaccctagacgtggagtgaattgagtgtgcaggttcctacgagttcactgcggttccagtggggattgggcaggctccaagcactaaataaccctaatgatatcaggactggtcctgtttgctccatcttaacattgttggttaacagtggactctgactttcatgaggatgactggacatccactgggactccaggaggctgcccttcgctgctttgactttgttctgtcagacttgataagattttgacttcctgttaaaacctgccatcgggtgttcagcaggagagtgagagagtgtcaagcacactgtaccagcatcagaggctgagcctgccagcagagctgactctgatggacacgtgcttcctagggctcctgatgcagctgctatctgcagacctcctggactgcccggggaagggagtgggagctcctgccacagatgggtggaacatcgacaagaagggctaaaggtggccaaaaataacagtgccttccagatgaggtgacctcagagccaagagcatcatggggtagagtatcttgttcccagttttatgacctaaaaagtacacagaagatgcaaagatactacagagagaaggaacaaagtctgcagagaacagggaaaggcgattacgtatcatatttttttaaataggattttgttgtacatgaccacaaaagaaaacacagccttttatacatgtttgaagagagagctagagctatagatagaaaaatgatagatagattaatagatagatggtcaatagatagatgatcaatagatagataagtaggtaggtagatagatgatagacagaaccaaacacaatagaagaccaaaaggagaaaaagatagagatgatattgccttcctttgtttgctattgaaacaaacttaataaatcctcattgagaccc

SEQ ID NO: 16 - DNA, 6633 bp, Homo sapiens
cggcgccgcgcggccgcgctagaatggaggcgcccagcggcagcgagcccggcggcgacggggccggggactgcgcccacccggacccccgggcccctggcgccgcggcgcccagctccggccccggcccgtgcgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatac

SEQ ID NO: 17 - DNA, 6166 bp, Homo sapiens
agcttgagccaccttgcctgacataatatcttaatgtgattattgacactattgattttcaaatatttaaattacctttaataactagaatgaatccttctttgcattttttaatcttttgtagatttgcatcaaagattatgagcaacatggatctgtaatgttctttcttaaaaaggtactagaatttattgtgaaactctctggtcctagagtttttgttttaagaaaattgttaattgtaattaatttcctttaatagctagagggctattcatttttaccatttacttttgttttacttttgataatttgtgggttttctagaaagttaaccatttcaagtacatttccatattaatgacctaagttgtatatatctttctacgatctcattaaagtctgtatgcatattaaggatgtcatcactttttattcttcatattggttagttgagtaatcatcatttttcttcagtgaacctcaccagaggtttatcagttttactaactgttttcaaaaattgatatataatagttgtaaatattttgggagtacatgtggtattttaatacctgtatacgaatccttttaaagaaccaaactctcactattcttcttgttatatgtttggactttaaaaattaatttctgttatttttcttatttccttcatatattttattttgtttaaatgtcttatcttttttgtaaatttctgaattgaataattatgtcagaggaaatcagaatttatcattttgtaatgtattacatattagaaacacgtattatatatcctgttataaaatttgccctaaaaagcattgcttttcaactagcacacaaaattttatatatagcacctcattattaatcaaattagaatatttctgaattatttggtatttgttcttagacatgtgggtcatttagaaatatagttattaatatccaaataaagaatctattttctattcgatattttgtgatttctggttccatttcaatctagagtcagaatatactctgaattatttcgatctttggaatatgtggggacatgctttaagttcaatatgtcataactttttatatattgcacactctaaaaagaggtgtaaatactcctacaaccacttagttttaagatcgtaaaagatattgcttgtaaacattttactgatttatctatattgtactcaaattttcaactaatcttctggatacttttctacagatgtcaagaattaaactacatttatacgttaatgtggttaacagaattttgtcatattgctatgacaaagtagagtgtttttacatacatcaattatgtcagtagtattaataagtgaataaatatctttacattactgtggtcttttccctttgttattcaatcaattacctatccaccctctcgtggtcatatatattaatggactttctaatcttttatgtaggacatgaacttcattgtctggtcatgcaggtatgattgtacgactgtacgactgtacaattttctttactgactgcctgaacattttggaggaggaaaggaacatgtaaaattatgagtattttttttaatgaaaattgctcattctccaagcaccaaattccagttaattctgtcctttttcccagtggcctcagcatgcagatctaagtgtacgaatggcacatggtttatgaggatgcacctcactggaccttttcctgaagaggaaggagaaaataggactccatcattttcatttgacattcttcccatgccctgtcttcattttgacatttttcccctttttggaaatgggcctttttcctttcttgcgaatgcatttaagaatttaagaatgcattaaattttgcctctaagcatgactttaagtgcaacctaagtcttttaacatgttatacactcattactgttcagttgaaaatattttccagttttctttgtgattgcttctaccacccacaggttatttaggttacttaaggccatctttttttttcccctgagcactcaccacattaactatttcctgtcttttaagcatttacttcatgtatagtaaccagtttctatccttgttccggataaaaatactagcttgagataagttatttcatctgactacaaattggacattaagcatgttttgtatgtataaaatacagcagtatgacaaaattctgttaaccaccttaaagttgaaatgtagttgaatttttgacatctgtagacagatttcttgaaaatttcagtgtttgattacaatatagaaaaatcagtataagcagtatcttttatgatctttaagtggttgtaggagtacttacacctctttttcatattcatattgaaatttaaagccattttaaagtaactttttgttatccagttattcactcagggtgatcagatgtctattcaaaacagccaacaatgagctaaaggagtgctgttccagccagaatcctactgctaccacaagtgatgaaagcacaagaaatcctccacaaaggtattctacaactaaacttctgaactaagggttggagaaaactggctctttaaatttcaaaataaaaatcagtttgtctatcaatataaggcaataaatactcattcaccacctctcatgtgccagtaatttctagggcccctatagaaatctgactgctgtgcacatagagggactgacacaaagacttcagtcacaggattctttgggtggttctaaaatagaagagacacttacaggtatcttaaagatcaggcatcgttccaatcactttataagaattaatgaattattataaattaattaatacagcaaacctgtgaactagtcggtgtaattcttgctgttattattcccgttgtcagatgggataaaagaaggtaactaatttgtgacaggggaaagtctcagatagtgaccagtggattcaggatttaaacccacaatgcccgattctggacactcgcgtttaatttctgcggcccttgcagctgccggcgcaggcgctgcacccagcgctgctccgcgcgcccagccccgctgggtcctggaccccgccggcagccggcagtgcctaaaggttagatctgaaggataggagagtgctgagaaggataatgcttttaggcaattaattgtgtgttctttaaatacggacatgttaaccacacggggctaggcagcgcatgcctgagctgtttggagtaaaaaactgcaggactttgcagcttctctccatcctgcagttcacttctgaacttgctccctcctcttaggatattcttagactgcccggacttcacctcagctctgccatcgcccagccttgcactcattccattcggacccccaaatgctgaccggccaggggatcccatgctaccctgcagactggtgtgtgcacaaggaaaccaggtcccagcctctgaggctgtcagtgttttgttagaaaagaaggcacagctgagccaaataactagacaaatgactaaatgtctactttctgagaactgtaaaaacaatattgatgctcaaaaaatatacatatgtatatatcatggcaggaatatagacaatggcagtcagaggaaatgatctctgaagacatttggataggatgggaactagtttatttttctcaggatgcactgcccagttatttccagttattcaattttttatggtatttaaaatcatgggatacaatattggtttataacagtttatatgaaatattgtcacgacaaaactaaaagataaagtcactatcagactataagacatgaacaccagtggcagccacacaggtgggcatttggaagcaaacactgcctggcaccagctgcatagccttgggcaggtgaggaaacatatgcttctcagttcccttgtgttaggagatgagatggtcaaatattgtatagaacttcactccaatgcagtaactactagcctcatgtggctatttaaatttataatttaaaaaatggacattcatttcctccgtcactctagcctcatttcaagtgcccaagaaccccatggggctagctttcatactgtacagcatgcatatatataaattcttcacagaaagttcctctggacagtgctggtgcatcaagagagggtcaaatatgatttagatacagtgctgggaaaatatcacaattaagcaaataatagatgcagtgctaggaaaatatcacaattaagccagtaataattttatattcaggattcttatgtttgtgaatttgtagagagcttggcgtaaaagcctgagagctgtgctgcaagtctttttcttgtaaaatcactggggctgacaaacaaatcctgataaagagaaagtttgtttcagaaagttcaagtgaggcagactttgggacagcttgcatgcaaaatataaaacttggtaactatgaaaaggagaaagataaatccaacatttcctacattcacgatgaataatcagcaccattttcaaataattatcaaattaggaaaagactaccttttaaaaacattgagccttctactgaccgactataaagactatatataaagtatcccacaatttatttaggtcttctgaagctaaaatgtttttaattttattgtataaccttaattagtttaattcctaggttagctaacttttaatgttgttatgaatgtcattaattttaaatgtttacttcaaatgttattgatgatagagaaataaaaatgatttcatatattggactcctgtccagtgtccttgctaaatgtacctattaaatctaatagcttatctgtaaattattctcaattttctgttgcattccatcaataatttctttccagttataacatcttttatttctctgctattacactagctaggacttgcaataataaatacagattttttttggcctttagatttatttcagagagaaagttttagagacctttatttagataattatctaaattacagatgtaatttaacagatccatattcacatgtatttctgctcctgtcatttttactaatagatgtttccaccaatatgactatttcatgtaacttttcaagttttatctcctaactttgttcctgatattctctaatgatttttaatgtctgttattaatgtagtgataacatatttgaaattactgatcttgggtattagagccttcttcatttttccttgataaatttcaccagaaattatctggcttcaataagcagtttaagggattttacttaatttatttcccttatttaatatttgtttttcttcattgcttttcttgcccttattatttgcttcattctgctttcattgcttttacctacttaattataatttaatttgttgacttgggtgattataaatattcagatatgtttccactttacagatttaggcaacaaaatttcctcaaagaaacttatagaaaaaaatccaataatatataaaatgatatatcacgacagaagggcttcttattagaaacaaattggttagttaaatatttgaaactcatagctgcaaataatcacattaagagaataaagggaaaaacaaaattgtctcaaaaaatgtataaaactacataacagaattcagtatgcagtcatgatacgtactctcagcaaagtaggaatacaaaaaaatgattaatctactacatttatctgcaaaaatgacaaaacgctcatacatggaaattaaagaccatcctttgtggataatatggcacaggatatgttatgaaaggctgtcctgccacaacacagcacagatggggttgaaagaaaggaagggaaacaaagggctgccatgaattaaaccagtagagaaaataaaagcctgggtcatgcaggggacagtgtcttattaggccagcatcaggactggttgaagtctggcgcttctaacacagtgggaaaatgagcatagtaatcacaataaagaaagacatctgaaaggtgctaacttagcctcggatcagaagtgctctctgctaatgccttgctggtgaaaagcgtatccagtgtaagccctcagaaatcccagaaaacaaagaccaaaagaaacggcgccttgtcaaccgaacgaattgaaaaa

SEQ ID NO: 18 - DNA, 1187 bp, Homo sapiens
tagggggcgccgcgttggaacgcccgaagaggtgctgctggggtggttggaagccggtggggggcgggtgtatggcggctaggcctggaagaccacgaggaccgctagcgccgtggggtcactcttcctcatgccacaggttgccgagcctcgggggagaggtggggtcccaggggccaacccttgggtgtgttgatggcggcaggctaacccagccaacggggtgccactgccgggcaaggtgaggagcaagaagatttccagggctgggaggtagagggccaggatcccaaggagagggcttactgcgaggagcagcccaggatggataaggagttgaggccccagggatgctgagcctgcacaagtggaagtgactggctaccagactctgaaaaacctaagtcctttagggaagaccacaaaagcatccaaccacagtctgcgctgcagcccggcagaactaagtcttgggcgccgcgacgcctttcctacggaataggtcctggaaggaagaccatttaagtctttccccccaggactggcgaggagagcacgccttcccttccgaaggtgcgttaccagattgctgccgtttttgtgctgggtcatcagagcagattcccctccaggttacagattaaacttaactctacccgtgctgaaaatggccggagcacgccgcctcgcctcccctccccaaggctgccggagccgccggcccctgcctccttttcgacgactgatcgtccaaggactggcgccggatccaacacctttccccagctctgcgcgtaccgcgctctttgggaacgaattggtccctgtctgcttccaagggtccctggaaccttctgcagctgtgcctctccagagctccgcctcattagtgccacgttcctggtttgaaaaccatagtacttcaacctcttctagatgggagttaacctttgccctctgaaagaaaggtttgataagcaaagagagtttggtgagcaagatccttgaggtaagagctgatctctgacgtccgctgggaactggccgctctgcaggtttctgtatcacattttctgcacatgtccattagaattggagatggggcgtatctagtgttgaataaaggcccggcagcctcccagatgcaccctgtctaaaaaaaaaaaaaaaaaaaaaaaaaaaaaaaa

SEQ ID NO: 19 - DNA, 1376 bp, Arabidopsis thaliana
tctttcgttttttgtgttcaactgtgactgtcttcattagatttgagactatctatttacattctgattatttcttaagaagaagcggccatggaagtcaaaggagcaacccggagctctatcatagttccttctgttcaagagatggtgaaggagaagatgatcacgacggttcctccgaggtatgtacggtctgatcaagacgtagctgagatagccgttgattctggtctaagaaaccagatcccaatcatagacatgagtcttctgtgttcttcaacctccatggattctgagattgacaagcttgactctgcttgcaaagagtggggattttttcagcttgtaaaccatggaatggagtcaagtttcttgaacaaagtaaagtcagaggttcaagacttcttcaaccttcccatggaagagaagaagaatttgtggcaacaacccgatgagatcgaagggtttggacaagtatttgtggtttcagaagagcagaaactcgattgggcagatatgttcttccttacaatgcaacctgttcgattacgcaagcctcacttgttccccaagttacctctgccctttaggtttgcctcaaatgtataaaatcattcttaataaatacacaaattttctctgtttaaaacttggtttatgtttcttcagagatacactagacatgtattcggctgaagtgaaaagcattgctaagatcttacttgggaaaatagcggtagctctgaagatcaaacccgaggaaatggataagttgtttgatgatgagttagggcagagaattaggctgaattactacccgcgttgtccagagcccgataaggttattggtctaactccgcattctgattctacaggactcaccatactgttgcaggctaatgaagttgaaggtctccaaatcaagaaaaatgccaagtgggtttctgtcaaacctctcccaaatgctttggttgtcaatgtcggagacatcttagagataataacgaatgggacataccgaagtatagagcatcgtggagttgtgaactcagagaaagagagactttcggtggcggcattccacaatataggattgggtaaagaaattggtcctatgagaagtctcgtggaaaggcacaaggctgcatttttcaaaagcgtgactactgaagagtatttcaatggcttgttttcccgtgagctcgatggaaaagcttaccttgatgttatgagactctaaaaggaaacaattcataaaaatattggcttgtgccccaagaaaccaatcacattttctgacccttcctattgtagtgtatatactctgtttctcctctgtttcatgcttttgcaaatagccaacatctctctctctc

SEQ ID NO: 20 - DNA, 2337 bp, Homo sapiens
acattctgccctgatttccggaacctggaagcctaggcaggcagtggggaactctgactcgcctgtgctctggagcttgatccgaaagcttccacagtgaggactgctccgtgggggtaagagagcaccaggcactgaggcctgggagttccacagaccaacacccctgctcctggcggctcccacccgggacttagaccctcaggtccctaatatcccggaggtgctctcaatcagaaaggtcctgctccgcttcgcagtggaatggaacggatttagaagcctgcagtaggggagtggggagtggagagagggagcccagagttacagacggcggcgagaggaaggaggggcgtctttatttttttaaggccccaaagagtctgatgtttacaagaccagaaatgccacggccgcgtcctggcagagaaaaggctgaaatggaggaccggcgccttccttataagtatgcacattggcgagagaagtgctgcaacctaaaccagcaattacacccaagctcgttggggcctaagccagtaccgacctggtagaaaaagcaaccacgaagctagagagagagccagaggagggaagagagcgccagacgaaggtgaaagcgaaccacgcagagaaatgcaggcaagggagcaaggcggcagttcccggaacaaacgtggcagagggcaagacgggcactcacagacagaggtttatgtatttttattttttaaaatctgatttggtgttccatgaggaaaagggaaaatctagggaacgggagtacagagagaataatccgggtcctagctcgccacatgaacgcccagagaacgctggaaaaacctgagcgggtgccggggcagcacccggctcgggtcagccactgccccacaccgggcccaccaagccccgcccctcgcggccaccggggcttccttgctcttcttatcatctccatctttatgatgaggcttgttaacaagaccagagagctggccaagcacctctatctcagccgcgcccgctcagccgagcagcggtcggtggggggactgggaggcgctaattaattgattcctttggactgtaaaatatggcggcgtctacacggaacccatggactcataaacaatatatctgttgggcgtgagtgcactgtctctcaaataatttttccataggcaaatgtcagagggttctggatttttagttgctaaggaaagatccaaatgggaccaattttaggaggcccaaacagagtccgttcagtgtcagaaaatgcttccccaaaggggttgggagtgtgttttgttggaaaaaagcttgggttataggaaagcctttccctgctacttgtgtagacccagcccaatttaagaattacaaggaagcgaaggggttgtgtaggccggaagcctctctgtcccggctggatgcaggggacttgagctgctccggaatttgagaggaacatagaagcaaaggtccagcctttgcttcgtgctgattcctagacttaagattcaaaaacaaatttttaaaagtgaaaccagccctagcctttggaagctcttgaaggttcagcacccacccaggaatccacctgcctgttacacgcctctccaagacacagtggcaccgcttttctaactggcagcacagagcaactctataatatgcttatattaggtctagaagaatgcatcttgagacacatgggtaacctaattatataatgcttgttccatacaggagtgattatgcagtgggaccctgctgcaaacgggactttgcactctaaatatagaccccagcttgggacaaaagttgcagtagaaaaatagacataggagaacacttaaataagtgatgcatgtagacacagaaggggtatttaaaagacagaaataatagaagtacagaagaacagaaaaaaaatcagcagatggagattaccattcccaatgcctgaacttcctcctgctattaagattgctagagaattgtgtcttaaacagttcatgaacccagaagaatgcaatttcaatgtatttagtacacacacagtatgtatataaacacaactcacagaatatattttccatacattgggtaggtatgcactttgtgtatatataataatgtattttccatgcagttttaaaatgtagatatattaatatctggatgcattttctgtgcactggttttatatgccttatggagtatatactcacatgtagctaaatagactcaggactgcacattccttgtgtaggttgtgtgtgtgtggtggttttatgcataaataaagttttacatgtggtgaaaaaa

SEQ ID NO: 21 - DNA, 8760 bp, Mus musculus
ccctttgtgaggcgcgggagagatgtgcaccccacatctctttgcttgagtcctggtccgcaagatgggtgcttgttcgtgtgccccaccccacccccacgcccgaggccgggtgcggcaactccgcccgccagccgctcctgcattaaaatttcatgggcgctgcagtaaacgcgaagacgacgccggttgcgctggggggccgtagggagggaggctgcggaccagagcggggaggagtttgcgaggggaggcgcttgggaggactcccccagttctgttaagagctgggcacaaagagccctttgcactccagccgcaggagcgaggaggagccgagctagatgcacatgggcgtggggactccggtacaacaccaacccacaaggttagcagcccttaccattcctccacttatgggccttatcccagacctggggcgtccagcgcagcctcaaacccagggcatctctgcactctcatcgcgacgtcgctctggatgctgtttgcatatccttggggagtcactgctttggcacaacagtcctgcgaggtgctggaattccgtctgttctcatcacacggacatggctgatctgtctcagtggtacctgggggcaaagcagggagccgggcggtggaggccaacattgttaccaagttggctctgtctcaacacagggactgagccttctgagcctcaagagttcctgctggttcccaggtggtggaagagtggagagatttgggaaaggtcacgactagcctgcaaagcagccttgcagataagtatcatttcaccagcctgcctgctctctgctggtgcgtgtgagaaagggtcagctctggaatccccaacgggagggaggatggccgtcctgtgactctggctcttgaagatgtcatttgtaagcttgaacaggctcctgggtcttgcagacacagggggacctcctcagggttcctccactcaggatcctccaggatcctgggacagtaggctctaagagcagctatgagatgtctcaccttccttggctcggggtttggaggacagatgtagcatgactgtcaggaaagagcaaacctgagtcctggtgtggaatgcaggcactcccttctctcttccaccaccctggtgacttgcagtggtccacacaagctctgcacactttggccacctgtttttttgttgtgggagtcacaggaaggaggggactgaggtgggcagagggctgctttcatttctcaaccatgccttgaatggccactatagttcccttgtgggacagggcagggatcagagagaggcacaggcttccagcagccgggacagttctaagcttagagttctagatccccctctgtcagcactgctcaccctgttgtcccctatctgcccagtttactttgagtttttctgggtcacacaagaacccacaatgctctaggtgacagaggaggaggaggaggaggcaaatggctcctgagccaaggcagggcttgtgcaaggtcatctcctggggtgcatcttgtgtgtgtgtgtgtgtgggggggggtagctcttctgtcttccagagtcatccagtgatgtctgtgtggaggaggagctaggagctaggccttccatgatgtcgatgatgtaatgatgtcaggtggtactgctgggtgtccaggggtgaacgccagagagatggcccaccctctgtgatcttcaagtacgacaatgcatcactacagctcagcaagcggacagctctgcacatctccagaccctgatctgtcttggagccctggagatcccttggattctgacctcctggaactggggagcaacctgtctccctgaagaccctatccttcccagtacctgagatggaccctccaccccccgaagaagagccattcctggaagatgtactacttaggagtcaccctgtctttcatggacagctccagggggttggggggaggctgcagcttagaatgggggggggcaccggaggcctcttttcatcccatgtggactggaatcctccagtctctggaaatggggtggagctaggccccctcctggccacagggtggtgtctcaaaggacctgtgggtagggcagggactctataggctcagaggaggagctgatggggaggagtccaatgtctgtctttgtctgtttttctttctttctttcttttttccgtttccattccttttctttttttgtctgtttgctgcttgagtgatgagtctgtttgggtgtttcctggggtgaggcttagctccctgctggttgtgggaagaggacagccagccagtcctggtctgggaggagcctggctagcccctgtgctattcagcacaggaaggaaccttggaaagagaaagggggcagtctaagataaggagacctagtagggaggttcacaggcagaaccatagccccagcttcctctagtcactggagaatgggctgcacccagtcagttacaaaggctttgcccaggacatgggagtgcccagcctgtaccccaatccatattgcatagctgcagagggacagaggctggcacatactccctcctcagggcccagtgcccagtataacctgtccgttcttcgcctcttgtcatagccctggaggagggtctacaaccagcaacggagcactgtatggccttccttgggacagtctagaaacaggaatcccttgactggggtaggggtggggcagttgcttattctgcgtcctggcctgtggtgctcagccccagagactcacaccacaggacttgaggctggcaaaacaagaccaaggtgccagcggtagcttatgtcttcacggggtctttctctgtgtccagagtgagtgagcgaggctccagggatttgtccatgacagccttgccatttcaggacccaggcttacgaatgacctcatctgagctcggtggtcttgtctctctgtgccttcacagagggcctagagattcagcctgtgcctctcgggggagggggggactctgacagggtggtctcacagacatgagcagctagtctccccttcagagttcctcacataggaaggaacagacaaacataagatgggtacagggttgctggcattgtgccagttgtcttagggacatacacggtggctgcagccagtacagagccagctcaggtctcagggtaccctctacaagcccccttgtctctaccagctttgatttccacatgtcatgtggaccatatgctctcttggtggcctaggcagctctcaggcagacctgtgcctgactcagtgctgggcactcagcagatgcaccatacagttctgttcagtgggagtgtagggagtttaggtgagggttcatctgggttggatacagtctgatccagaggcatttctggctgggccactcaggtctgccttgctgaccagtctggagcagtggccacctttggtttctgttgtagcttaccatgttttccagaaggagatgaaccttgtttcctgctagaccatggatcccaccatggttcttttatttgtgtagccatcttgggaaatacaggtgctatgcaaccacacctcagacatttacaactttgtagtcatcagagagaagctgtgtccaggaagaattagacaataggcagtcaagagaggccagctctggcacgagggaggaagtgacttcctagtcaggctgacccccactgggacgttggaggatgagaaaggtatggcttgactgagtgcttttggaaagaaattaaagcaaaattcaaataggtcaaatacagggtaggacttttcagagcctcaaagtgctaatgggcacctcagacactcaggctgggacggaaggatgagatattatctgtctttgctggctacagaattattttcttaccaaacatatagaatgctgggagacagcattaggctttagaagtgcgctcaggtgtcctattgtcgcctgggaggaaagagaagctggaggggtggggcttaggggagtccaaactttgctttaggactcaggctaggttccttgcagttctttctttgtagaggaggccagtggtgggagcagccagagacccgggagttggtgatggaagagatgttcattttcaagggcagcagctctggggggttggggttggtagtgagatgctggtgtgtgtgtgtgtgtgtgtgtgctggtgcgcacacgcacaagcatatgaggagatccttctgggaagaggctggccacaaccaggcagggggtttgcactgaggacaagctgggtacatttttagcagatctgaagtgtctgtggagctccaagacccacagcctagaaacggaagctctgggcttccagtatggggttcctacggtgggtgttgatgggatatagaggcagaccccctgcccaggtcaggccccatgcccacgctggtggggacaggaggcctgtggtggggaggcagagggccggaggggggttgaaaggggaaggctgcatggtgtgattaacctactaaccaacccagggctcggccaggacgctgtggcacgcgacgagatgcctggccttctgtcaaccgactaatccactaacctggcccgagcatgtcctactaaccccgcagcagccaaaccctactaactctgcaggccaggggccttcccagaggctgggacgcggacaaggctcaggaaggccctgcctgggggctgggatctatgtgcagacccatcctgcgggacagggtatgctaagagactcaccaactctgccgctccctgctggcggaacgggacccttctacttcccttgatgcccgtggtgaggtgaccgaggtgttgccgcatggcagggacttcaaaatggaataagacacgctgagggcgggcctcgggggactcggtggtacgcccattctctgatctcgggtgttctgcacacagacccttctacctggggcagacatgtgctttgagtcctttaacgtctcttccctttctcccctcttgccagctttctctcccataggcagctcttttgattactaattgtctaaccccggggcaccccactctgcaccctgctgccccttaactaacggccaccccgctgccttcttctctctagtggctcctgtgtgtgtctgctgatgctgtgctactaacccggccctactaactggtttctcttcttactaacccagccctgccgagctctgggcttcctgggggctggtccctccttttggcaagcagatgtccccaggctgtccaggccagatctgaggcaggggacagccgtatttagtgacgcccagaggaggaggaggaggaggctgtcctgtggacgtgggacgctgggctccgagcatgacctctctcctctgtgcacaagtctggttgccaccaggagtggatgggaccaggggacctcgtgggaaccattgtggtgcccgtggctctagaattggcaattctgggccctacctagctggggccctctgtgatttagggcagggagagaggggtaggaacatcaggggctggccatcttgtacaggagctcaaagtgtgtgtctgaacccaaagccctacctgggagctataaacatgtttcctaagcaggaaacatgtgaggggccatttccctgaaacaccacagcgcagagaagcccgaggagagagggcatcaggaagtttgtaagagggcctttctctcagcctgagaagagatggccgatgaccagtaagaaggttctccaaataggcggtcaactagccaggcctttcccactgagagaggcggaaatctcaaactggaagtctatttgggatcatttttcacacaggaagtaggtgtgaggatatttttttccctcaggaagtgtttagaaacactctctccacacttagagaggacaggctgccagttgtcctgatgcacagtcgggaagcgtctctacgggcccttagggcttatgggaggggcaaatgggtgccaggaagtgaatcttagaagcccacaggcggatgggaagtcaccccagctccttgttcggtttatatccatgcccctgccccagccagcctcccccagagcccgccagctgctaagccagggccacacctgggggtgatttcatgcctcacctccagtaggctcatggcctctctgggctaacctctggctcttttgcactaactctagctctcccccagctaatccctgcctttccctggctgccccaggggctgaccactagcagccagccccgcccacccgcggggctccaggctcctttaaaccaaccaccctttcctctggactaatgtttgcctttctggtctgttccttccggcagaaatgaatggctgtggatttctctctgactaacaggtctcatactcctctccctgttaccactaacggcttggatgatggcggcgtggctggcgagggatgggcggaggtgctgagcttggttgctatggggaggatgtagctagtgagagtagacacgtgaccggtctgggtcagaacttccaaatgtcaatcaaagtgctaaccgggctggggtgtggctcagcccagaagaaaggatactgtctactgagcattttggtgggaccagacttacagctaaccttccatgggtgtggccactggctccatccaatatagccttacaatctacattggccgttagctcctgtaaactacagcgtcagttcttgcaagcagttcttagctcatataggagcctaagacacctgtctggtgggcccaatttgttacctatggactcattgagcacaaggtcatggcctcccttgagtctttgtttaggagacttacggagttttggccctatgacaacgtcaaactccagatagaaatacattctccatcgcttacaccctagagtaaaatagttcgacctttaccttcaagtcttctaaggcagatcttttacacagggtaggtgtgcagagggcagggagtgtggctggcagggagttaggaacccttaaggcaaggggaagtcctctggaagcagcggcagaaagccatgaggccataggacccttgtggagctgagggtgacaccagattgaagtgggcaagagaagagagcatgtttcacagagtgatctggaagccagagcttagaaggctggaggttcaaggacaggctgcctgatctgttggtgctgtgagaactgcttacccacgggcttaggactgactgtagagatgccagagagtctacggagggacctgagccacggaggaaatggagagaccccgtaggaacgtgggtttacctccaggtacggcttgtacgtactcgctgctgccctctcatggccaatcttccacatttcaccaacaatgccctgagaaaggctgcacaggggactttgctccggaaactgagcagaagcctgatcacaaaaggcctgacagcgtcccagtttgggacagtagctggtccctggtggctgtaattatgtgtggtgggccctggatactgaagggggcagggatcaggagagctaagacgaggtaggcagggagggctcgctgaagggggatcatgccagctaaaccttgacaggcagggagggcatggctggaacaagtcacgctcgatttagggttagagagcaaccaaacaagagtctggaagattcatggggaggtgtataaagtgagaagctcaatatgtgacaagccccaggcctcattggctgtaaaagacagacttcattccttgggataccagatatagtctgtaattgtaaccccagcagttgcacaatagagacagatctctggggtctgcctgcctgccagtcagccagtctagctagcatcatatgatctgagagagaaggtggcaggcagggccagagttctcaggctgccttggtcgagtcagcccaggtggggcagggaggagcttgccttgtgcgctggccacattatagaaaccaccagaacttctggtagctgggaagacacttcggtccatctggagaggagcgggggttcatagtgtgccacccttcactggggatcgtgagaaatccccggaaagtaagggactgaggggacaacgaggaacttgaaacttaacacaggccccggtggtgtgcacctcctccagaagatctggagataggtggtgttggcagtgatggtggtgatggtgtgtgtgtgtgtgtgtgtgtgtgcatgagagagtgagagagacggtagagaaaagagaggctataactcgagaaaacggagtccctgaggctcgttctaatcgcctgcatctgggctgcccctgccccctaattccattcaactttaggcttgtttgagcaggacactgtgcgagcgggactggcctcttgtctgaagagctcatagcctgcttggagggaggagcctcggtggctcctccccgagggtggggctggagacagcgaggaaagcctggtcctgtccactctggaatctgtctagggaacccattgttttataaccatctcagcaaagttgtctgttccatgttgttcctgctgggagagactgagcgtggggccctagaaacctgatgtagattaaaagatgtagatacttccatgggtccagccacaattacgggctcttttggttttcatgcttgtagctgcctctgtgtaagatgccatttcaatattaaaaccgacacacactgga

SEQ ID NO: 22 - DNA, 2529 bp, Homo sapiens
agtgctgtattgttgagttttgtatgaactaatctagcttctctaaaaaaaaaaaaaaaaaaaaaaaaaagaaagaaaagaaagaaagaaaagaaagaaagaaagaaaaaaaaagaaaagaaaaaaaagagaaccacagctttggacaaaagtctatagccagtgcatttgaaaactccccttgcaccagggctgactgtagctgggggaagacattttactcatttgctctttcctttcatacagtcagctggtccctcttctcaggtgtagatcacctattataattttacctaattttgatactctgataaggaaagtcccaggacttatcagctgggataggcctcacttacaagacagctctgttcagtatttggaagaaagcctgacaggtttcttcggaaaagtggccatccatggaatgaatgaaatgttctctttctattccagggattgcagtggcaaagctaggctaggtcttggaggctggtgtaaggcgatgtgggtgaaggcaggaggctgatggaaagactggggggaagaaaagccgaaatggattcacggtgccttggatgaaggacgagaggggaactgcaagctccttcaactggttctgtccggtgagaagtgatcaagcttgggctgacaagaggctcagggagccctcacgttctttcgcttttttacctgccaatcaaactgctacaagacaacaccctgatctggcatggacatcgcgggtccaagcctgtagccccaaatcggataatctctgcagctgataacaagcaaaagagaagccaggcaacagccatattaaagaagaaaacaatcaactctgagatccaacttagaaataatgtttcattcaagataaggctcgtggcttaggagattgtgacctggcttgcatcattctaagacttctatcgtctgttttcaaaacccaaggaggacctccttttctgtgtgatagttcctcatgctttgccagccactgggtctttaaggaagcttgccaagagttcccggctgggaaggacagttcgagttcatcatagacaatgagctggcaccacagtttaagtgactcaccaacctggttgcccacttcaaaatgtcaagaaccacactatctaattgaaagaactgtgttttagcaaagtgtaattggatcgcctggcaagatcatctcaaactatgtctctgaccttgcctttcagtggctattttgagcacaagaggagaaaggaaatgattcctgaattatatcttgtttttaaaaattaagattaattaatacttggttttatgttcattccattgtaggaacttagtgattattacaaaacagtcaaaataggtcatagcaaaatgaacgtttaagattaggttaaaacattcctctgaaattttagtattcacttttgaagtgtcaattactatatttctgtaatttctcatttttttcttggcttagagtcaagatgaaaaatgatatttgaatcaaagacattgttttgttatatagccactcctttctaaaatgcaaatccaccctcccctcaccaatgctttattctttgtgcgcgcacacacacacacacacacacacacacacacacacacacacagacatacacagaaccagcacccaaatggtagaggaggtccttccaagacttctaggacctggatcatgtaagcagtagatgagaaaatgaagtaagagatatagagtaataacaataaaagtcaatgatttcattttacaaaaaagtcattgtgtagtactcagatatttttaagagcaagtattattatgactaaagtatattatacttctaaattattatgattctcatctaatttcaagccacacataggcgccatttgaaagcattttgtgttacaacctatcaacaaaaatcaactaatagttttataacgtgcataggtttaccccatggggaattaaaatttttatctgcaagtatttctgttgttgtgagactttaggacaagacaacatttggtgttaacatagaagaatattctatggcttttttagctttaaagttcattactctaaaataaagtacacgtggtatttttttcttcctagtgttctcttattatatgtagagtattttcggttgttgtttttaacgtatacattatttttattaagtcatttcataaaagataagatatatactaatagacccttggttttctcctaatttaattatttcaagtcaagcaaaattgggcaattttctttcaggaaaaaaaaaatattgagcatgattttgaggtaaaactgattatttacagcatcttttctctaataggctaacatttatgatggatcttatttcaaagttgattattctcaaagaaaagtggagatattagaatttccgagtaaattgcattgttttaaaaagtactttaatgcattgttcacattgttgccagctattgaccaaaaaaaaaaaaaaaaaaaaaaaaaaaaaaaaaaaa

SEQ ID NO: 23 - DNA, 3584 bp, Mus musculus
tcactgcccctcagggggcagggggctggtgattcctgagggagccctgcccccttccagggtgaattttcctaagtcaccatggagaaccagcagcccagaatcagtgccctgccaggcagaattgcttggccataacaaagatccattgcctttctgatgacacccagcacctcggattctgtatacacgggaggtgatttaagcatcttactgccaccctgaaatctggggtcctttatcctggcagcatctagacccgtaacgcccacttcagaatgggagggaggatgtctgctgccctgtcgtctccacacccgaggaatgtccgtgtgtgtgtgtgtgtggtgtgcacagcgggctgcacacagcgggctccacggtgctcgaatggaggccctaatgtgaatggagactagcctgctggtagagaccttggcagtgaccgctgtgggcaatgagccatgggccaacaatattcaatgctgtgtacctgatggatggttactgtctgagactgaggctttttgggccaggagtaaaaggacttggtttgtacttgattgcgtcctgtggatgcttgcctaccaactgactcatcctgacgtgccaaaggtcctggctttcccctgtgtgggtaagggaagaagagagttctaatgaagactatagcagactgaattactctctgagatgaggactttgctattgccattgcagaaccactggtggaagttgttgttaaacagtgggtcttgcatgcaagctctacagttatgcacagtatttccatgacatcccaagccatgaggttcatgctgccatatccccctgtttaacaagtgtggaaactgataatggactcacaattgctgatgtataggttctaatgttttctattgtggacacgggacacccagactgagaaccaatggctccagtctgatttaaacatgggtccgtgctcacacactcaatacctaccctctgtgctcacaagtcctgtgtgagtaagactccaaattattctgtcttgttttactcaatggtatgctctaccttattatagagtataccatgtattgagacaagaatgccagtcattctgagaaacaaaatgcaaccattagttgtcattttaattagtgacgaatagttgtgtcaatcatcaaacatgcttgtataattggatgagaagaggtgtaacacgggccaatgatgacgaggtttcgggattataagtcacggacgatgactacgtcactagaggtctgaggtccatagcagaagatgcctcatgtgaccctctcatgcaggggttgcatgtcaggcatgtgcatacagtagatattagccatgcactctcaccatttcatagtagatcacagaatcaagatacaaatctccatgcacggaaaggatttaaggcattgatcaatcctgaacataaatatttggccatcaatgatatttacgcacacactgaaaaatctattcagaatgacttacacaaaggtttatataacctttatcaaaggtaatttatatagtaagattcatggctgaagtcttcatgatggtcaaggccttaatttttaaaattatcaatttttttcttttctttttttttaacttgaatttttttttaatgaaaactatcatgacaatttgtctcttaaatgaaaggagaaatgtaaaactaaatggacaaatatcaacctttttattatctttgctgttgtgccctccctggatgggtgctggcacatgatgtcttgcctgctggtccgtggttgcactctcaccatgtggatggagctcggcagctgaaaatgcattcttccaccaagatgatttacacagcctagctggatcaggagccccctaataagctgcttcagattgtaatatagacacagtaatgtatgcctgcaggatgagtcccaccttcttcattagtcttgaggtttgagattccctgtttgtgtctgcaggattcagatagtaatggatatcctgcaagtcggcttcgtagagtctcccttgaaagtggacctcatgatctagcctttatgtccgtggattgacactgtgatggattccccccaagttcatttagatattctctcttattcataaatgtcacggtcagctctgttcttatagataccagaatggatacccctaagctgatgtatatacacccttcctcggttgtgagattcctgctctggtggttgtagtcataagatatacatcgttgcgtacaccttggttgtgggcacgcacactactgttgaattaccaccttgtccaagtggatggatgccctcaatgggattggcactttctccattgctcctgcactctgttatcagcacttcgggttcataatgtacacacagcaatggattttctgcagctgattttctatattctgttttcttcgggtaagcagaaacagatgccttcctcactggtcaccaggttcaaggtccctcatatgtgtcaggtgcatagtcaccaacaaaggccaacttcacatcaatgggtggatcgtacctcggcctaagctccaggattgattgtgctgttagagtcacagctacaaccggctcagggaacccagtggaagaggaggtggagtgtgagagccaattggaatggaagacagtgaggaaacaaggccttcgagacacaagaggactgctgagctcacaaagactgaggcagcaccctcaggacctgcacaggtctaagcttgatgcgatctgagtactgagagggcaactggacacaattctatattgataacccagaagctttctccagttgataaactctttcaaaggaaaaacttgttttctaccatggagtgacactggatatagaaactaccgttaacagcagactccatggctcagacttccaatacaatatgaactcagttgcaattttttgcaaggtttttcgactcatagttctttgtctgggtactttttcaccctacagagaatttctgtatatattatcgtttctgattctagtgttttgaattttcgctgggtctaaatatctctgtctcagtgtcagtatgtgtttctcatgatttttctttgcttctctttttcctattctttgcttgtattccctggtttgtgtttgagtgtctgggaactctgagggtctggttggtgatattgttgttcttcctatggggttgaaaaccccttcagctccttcagcctttcactaagtcctccattattatgattcctatgctcagtccagtggttggatgtgagcccccccccccctctgcatttgtcaggctccggcagagcctctaaggagatagctatattaggctcttgtcagctttgtttgtttttattctgtcttctctatactgtttattttagataactgtgtttattctaatgtatgaatgaataaatgggtgtgtgtttgggtgggtggggaattggggagggtgggggtggatgtgggaggggaaactgtaacacaaatacattgtataaaagtacattttaataaatgtatttcttctatgactaaaaaaa

SEQ ID NO: 24 - DNA, 500 bp, Mus musculus
  misc_feature (231)..(231): n = A,T,C or G
ctacgatgttagagcccaagtctcctaaggccaaggacagggggcgagacttgcaggcagcaatctcctgaggttgtgttactgttgatgggtatgaggaagttgaagggagcaacaccccacaccagcaggtcattgtacaggtgtgcagccagtgaagtacaagactgacacacaacacactccacccctcctccctgactgccttcagtctgctgaactgtgtgtccntgtagctaacaccaaatagaccatttaaatttacagtatttcttttgaacttaggttgtacatattccttggaattaatgtggagatagatagtaataataatatgtgttgatgaaatacatagaagtaagaaattaactcaccatcaaattcttaagccctcctgggtgctctgaaccaagtatctattaaagagaggcccactgcccttctgtgttcaacgggaggggagaaggcctcaaccccctcccctcccccctctcctacag

SEQ ID NO: 25 - DNA, 12801 bp, Mus musculus
aggcctcctgtaatatcagagaaatacaataacgtatcatacaactcagaactaattcaagaagtctctagagcaaccaaagcaacaaattaggaaaaataaagacacttggaacattctccaacctgggatccctctggctgtatcaaacagtggacacatggtatagccctcattttcaaccacatcaaacactgtatgtaaagcttactaaaacaaaaaaatctcagctagaaaatacagatcagaaccaaattcaggcgtggtagacatctgcaaggattagatggtacatctaattatgattaacatggtaaaagtgctaaaacaaaacaaaacggtagactggttttgacccccggacaagggacagaagtgcttattttacatatcaatgcagacctgggttccaggttctactagcagcgttcagtccctgcctgatataccttgttcccaaccttgaactttccagttcaggggcttagctgcccttccacaagacgttctttccaatgttatctagacattttgcgccccacccttctcctctctgcacgagcgcaccccttcttcccttttctcctctcccctctccccatggcaactcctcaatccttgaagccagtgaactccccgagagcagttccccaataagcctacctttaatgcaatcggacttgaatagtctcgtttcacgggcagagaagtcattgatcggagacaacatgcatgaataggagaccaacaccatcaacacaaccgatgctcaaaatcaatagcattaagaagtgagcattcataaagatttggaagctaacacttcagagcacactccagaagaacaaatggggtgtgaggggaagggatttagttagggattttgcttgtcattggcggtgcatctctgcaatcccccaaatctggaaggctgaggaggatcagaagctcaaaggctgcctggaatgcgtggggagaatctccctctaccaataaagagacaaacaatgccagacaagcagaatgtatcaggagacaactggaaatgggataaagatacaagataatacctaaaacctaatggaatgaatgaagctaaagccgcacaaaggtgtgtgtattggggggtggggggagttacagatgcgcattcctaaggaaggaatctctgagtcaccaccacctgcaggaaaaccttggcagaaaacagaaatgacaaaggctcgagcgtaaatacaaaatttttaaatgctgtttttcttgaaaaaaaaaatttttttaagaagctgatgaaactaagctacaccaataacaaactcaaatcacgtttgcaaaaggaaaccttacaatcagtcaatgcttaaaatctctcaagagccgaagcagaagggatgctatctaactcaattcatgatgccagagtgatcctgatatcaaagccagaaagagacacaaaagaaagttaaaaatttatagcccacatccctgatgatcatcatcatcacaatatccataacccgagtttgatggaattaaaatatccaggtgggatttactcatggaatgcaagaatgattcaacatacaaaaatcaatgaacacgatatcaccacaatacaatgacgatcatcttgatagcattaaaacaaaaacaaagaaacaaacaaacaaacaaaaaaacccacggggctggggagatggctcagcggttaagagcaccaactgctcttctgaaggtcgtgagttcaaatcccagcaaccacatggtggctcacaaccatccataatgagatctgatgccttcttctggtgcatctgaagacagctacagtgtacttacatataacaaataaataaattaaaaaaaaaaacacttggaaaaactcagtgtactcatgattaaaaactctcggtaaaccaggaataggaggaaattgtctgagtacataagggccacattgaaaaagcccacagctaacatggtcaatggtgaaaaattgagtgctttccctttaataagatgaaggaaccaagaatgtttgctctcttagattccaatcctaatagaattgatagtcctgtgcagaacagttgggcaagaaaaggaatccagggctgggactgtgccacagtctgtagaatgcttttctctagaatgcataaagccctatgtgcaatcccaatagtggtacaagcctatgaccctgatactcaggacgtagaagctagaggatcacaattcaacgttaccctgggctaaagaccctgttttactttattactttttttttaatatctgaattgtaactgactggagtactctgctcacaaatgccatgatcatttatgtgggggacttacgaaagtctacacacacatacacacacaccatacaactcaggtaattcagctgtaaagttataggatacaaaatgagtatataaaagtgaattgagggccactgagatggctgagcaattacaaacacttgcccccaagtttgaagacctgagtttttgtttgatacagccctggctggcttggaaattactatgtagaccaggctggccaccaatttatttaagatctgtctgcctctgcctttgagtcctgggattaaaggtgcaagccactacagcaaacttggtgttatagtttaaatatatggtttactcctagcaacttgtatgttgtcttggtgctgaaatgtggtggcatctttaagagggtttaattaatttctcaagagcctagctgagttcttggattttaagaggaggttgctataaaatgatcctagcatctacctgatagctcttgtgcatatattatactggacaaaatagatgtttccctaccacaactctcctatgagttaacactgcttccaaccagaaactgagaaaatcctggccagcacagtcttgaatgtctctgtttccagaattgtgagctaaatttatctttactattcgtgacttaatctaggttgaggaatgttgctataacaaaaaataatctgagataattgctctgactagaacatttaatattgttaaaatactacttctgttcaaagtgatctgtagagtcaatcaatatctatcgcactcccaatgggtttttgtttgttttctttttgtattttggaagtagcaaaaataactataaaatacatatagatgcgtgaagacccatgaacagccaaaataatcctgaaaaagaacagctcttgtccaatggaccttgggggaaaccaaacgtcacattttacacagagcaggataaggtattggttttcattttgcctctccagaacacaaaacctagatttttttgtttgtttgttcatctgttttaatagggcctcatctttagcctgggcttaccttgaatttggagtctgcctccctcagttgctatagttctgggattataggcataaggtgcaatttccagcaaaaatcctttaagggctgcttgaaactcactatgtagctcagcctggcctcaaactcataaccatcctctcaagtgctaggattacatgaatgagccacagtagcagctaaaaccctttacattttattagggtatattctatacaatatgagtgtcattataacatcacatacacgtaagattttgttcctattcactcccattactctctttttttctccctctcacttttactgatccccttactctgctcacacacttctgctttctggtttcttctatagcacggatgaagggttatttacaggaacatggcagattcttaccgaagaaagtatcccccccccctcccaactccctcagcaaacaataactaccaataccccttctgcagggaggaatgaggcatcttggtcccttacgtctagacactgttaactgcctcctcggggagggatgaggccttgtgagcctcttgtagcaactgttaacttcctacacatcctaaggaatgtgggggtccccttgtatacacaggccttgggtagggtaatcataggtgctgtgagtttatgagtatgactgctgctgtatgttccacaataccccatcccttcttccagctttacctttctgccctctttgctgtggtgtttcttgaaccttgcaagggaggagatgcaaatcccattagggctgatcttcaacaatcacacaatcacacattcttttttgtttgtttgtttgtttgtttgtttttttgagatagggtttctctgtgtagctctggctgtcctggaactcactctgtagaccaggctggcctcgaactcagaaatccgcctgcctctgcctcccgagtgctgggattaaaggcacgcccagccaatcacatattcttatgactcagagctaaaagtctgcacgaacagaaactagtctcaccaaaactgacagtagcacaaatctacaggtataaacatacatggttagaagacaatttgatagtcataaggtggccagctagggaggcaatagtggtaaagcttctccattagagcctatggtctccccagctagaggcttttgacaaggcatgaactttctcctagcaagtgagcctcaactccaatcagaaagttaattagccaaataaaaaaaatggtaccctgtgctcattcacaaactagagtcatccttcaaagaggaggccttaagtaagaaaatgccttcatcagattggcctgtgagtaaatctgtgggacattttctcgattaacgatcgactgggggggggggcagtccacttaaacccatgtgggtggagccacccatggacaggtggtcctgggaggtatgaaaaagcaaagtgagcaagccatggggagcaagccaggaagctgtcctttgtggttcctgccctaatttctactgtgatgtggatgtacaagccagataaatcctttcctacccaatgtatttttggttagaatgttttatcacagtaatagaaagcaaactaaaaactaaaacatctttctaactttcatgccacagtttctttttcttcctttcttttttctttcttttttttaaagatttattttattatttattatatgtaattacactgtagctgtcttcagacacaccagaagagggagtcagatcttgttagggatggttgtgagccaccatgtggttgctgggatttgaaatctggaccttcggaagaacagtcgggtgctcttacccactgagccatctcaccagccccctttcttttttcttttctttcttttcttttcttttcttttcttttttttttttttttttttttttttttttttttttggtttttcgagacagggtttctctgtatagccctggctgtcctggaactcactctgtagaccaggctggcctcgaactcagaaatccacctgcctctgcctcccaagtgctgggattaaaggcatgcgccaccactgcccggctgcatttttttttttttaaattaaaaaagttgaacctaggtgtgttgtctcgtgcctgtaatgcccatgttcaggagagagagagggagggcagggtgattactatgacttcaacatcagcatgcgcttacatcatcagttagaggccagtctgggatacagagtgagaacctgtctcaaaacaaaaacaaaaaaacaaaaaacaaaacaaaacatcaactatcataagtgacttaaataatggatattaaacctaaatatcacacaacttcacttaagaaaattctgaggactggaaagatggctcaatgattcaaagtgctttccggaggaagcctgaacaccacagtttgagtcctaacacttttatataataagctaagtgtgggcccatgcatccctataagtccagcactgaggctagcagagactggaggattaacaaggcaaacagaggcagacacggtaacagcctcttcatgcatgcactagctcacacacatgagtgcgcgtacatcacaaacacaagcacacacaataaatacatttaaaagttttcttctttctttgtaagtgtgaaaattacaaattgtagaattttgatccagataagaggatcaggagtttgaggctagcctgggctacataagaccctgtttcaaaaaccaaactaaactaaaacacacacacacacaaagttgacacaaattttcaccatgtattcgacgtgtcaaggctcacctgggtcatgcaagactaaataaattaattgtaactaaatgcaagactaaatgtctaaagtatttttgaaagtctggcttaatgcaatttgcttcggtgttttgtcagatgacaagttagataggtcattccatgcttgtttacgaacaagacaagtaaaatttctcgagtctctgtctcttggaataggtctttccactgtaggtgggagggaaatgtttctgtctcccaagtgctggaatttaaaggtgtgggtctggttgaactcgtttttgtgtccttcagtggtcaggtgcccgggctggtgggtggggtgggaggaggagtatctgtctctattgttcctggactgatcctgaagtgtaacagaagtgaaaggaaggttgagtggagggctagtggacagtgactggcccacaacactacctttaagaagacaaatggaccatagtgatgtacacctataatcctagcacccaagaggcagaggcaggaggatcactgagttcaaaaccatcctgatctacagagggagagagttcaaggacaaccagggctatacagagaaaccctgtctctggggggggggggagcaaggaaaaaaggaaggaaggaaagaaagaaagaaatgaagagaaagaaaaaagactaataggtcccagagactcccatgacattgggaaagaagagtctgcacacttcctcctgctggaattcttgataagaaataacctccagagaaatggcaatcatttacaatttataccacaaattatactacactggaacaccatagtaggccttaggagaaaaacagacgcttaaacatccctacttggaggctttttgaaaacaaagtaaattatctttactgagcaagaaaacacttggtgtctaggtaaccctgtagcatgtgtgaaacaaaagactattgcccagacagagcctcaactttctcctttctattaaattcacagtaaaaagcaaacatgtatagacataagtaataaagtcaggtgtaggcataaatcaccgcatcttttctacaaaagtgagcttaagcgttttacctttttaggacagagtgaaaatccggaagttgtcttctgattgttacatgctgccacggtcctccctgtcactgccgccattgggctatggcctggtgtctgtactcaaactgaaaacttgcaagctagcacacgtgctgtcggagtgtggacgcacgggtacacgtgcgcacgcatgaacacacacacatgcacacactcgtgcgcacagacacacacacacacacacacacacacacacacacacacacacacacacacacacacattttgcgcatgcgtacagatatgtgcgtgcgcacacacatacaggcacgcgcacacatgcaagcgaataaaattaaaatatggtaggcgcatggtagaacatgcctttgatcccagcatttggaggcagaagcaggcagaactctgaatttaaatccaatctggtctaaaatatgagttccagttcatccaggaccacaacaaaaagaccctgtctcaaaaacacaaatcacaaaatggcaaaatgaaacaaaacaaaatgaaaaccaaataaaatagaaataagaattctaccttcagctgagtgtgtgtttgtgttatatatgaatattgtgatgaatatctgtaatcccagaactgaggactttgagacagaagaattaggagcttgaagccagcctggaaaagatggccagattatgactgtttttctaaataataagtaaagaaataaagaaaaggagaataacaaccaagcgtggtgataaattcgtgacctcatcttctatgtatatgatgtaaaagtcatgaagtaataacctcttacaatattcaagtagtagctttacttggaaagaaagattttaaaagaaattttattttttagacagtcaaaaatataattaagaagtatcgtatctgtgctaagcagacaatataaaattcgggaacaaagaacatatatctttatctgtttgcttatttttatttatttatttatttatttacttacttacttacttacttacttattggagacacatttttttctatgtaacagccctcactattctggaactctccctgtagaccaggctggcctcgaactcacagagatttgcctgcctctgcctcccaagtgctgggattgaaggcctgtgccatcactgcctggcactttttctttctgtctctgtctctgtctctgtctctgtctctgtctctgtctctgtctctgtctctgtctctgtctctgtctgtatctcttccttcctttctgtctctttcttttttatctttagtatttttaaaggcatgtttttatctgctagctatttatttttgaggtagagtctcacgatacagcctcaactagcctggaactcagaaagagccgtcttcctccccccaccacacctggcaggttccttttaaagacattacttctcaactcaaataatgctaaaatcaattgagctgtttatcatctgactattgttggttagctagaaacttctgaagtgttgcaatgtttagctaaagtctagaatttgctgtttttccatgtgttaagtgtcaggaaatgcgaggtaggtaagtgtttgaagatagtgtctgccattatacaaaatgctgagtgataggctgattgagtgtacaaccaaacagatccagatagtcaccaacttatttattagttgctggactggtttttaccaaactatgaggaaaagtaggagggataaaaaagagtaatagaggggtgaatatgcaattatgttatatgcattatggaaatagttaatgaaatctttactttgtacaaatagtatacactaattaaaaagatacaaatagctgatatgcaagataaataagttttacagatctaatgtatacatagcacaggcactacagttaatgatactgtgttagatcctttttaaagaaaactctagttttgctgagcgtggtggcacacgcctttaatcccagcacttgggaggcagaggcaggcagatttctgagttcgaggccagcctggtctacacagtgagttccaggacagccagggatacacagagaaaaaacaaaacaaaacaaagagtactgactgctcttctagaggtcctgagtccaattcccagcacctacatcgtggcttacaaccatctataattccagttcttaggggacattgacaccttcttctggcttctgtggacactgcacagatatggtacctaggtatggcagccaaaacacccaagcacataaaataaagataaataaatatttttaaaaagggggatgggggtggacagatggctcagcggttaagagcattgactgctcttccagaggacctgaattcaattcccagcaaccacacaaccatctgtaatgggatctaatgccttcttctggtgtgtctgaagacagctacagtgtactcaggaaaaaaatagttttttttttttaagaaagaaattcagatatctgctgtattgtactctttattactgccaggacaaaatgtccagaacgataattcaaaaatagcccactgacttttcacgtgctagaaggtagaaagtgatagcagatttcatgccatgcagatgatccctgtttccacagaggtgcttctctcacaagacagaagaaatggaagagcaaaagacacaaccaggagtgtacttttagctgttcttacaaggacagggacagtaatcgagtcatggaggcattaccaaatacatccaaaaaggccttatctttcttgttgtttttgttcagttggttttggttttgaggcaaggtttttcggtatagttctggctatcctggaattctggagtcaggctgacctcgaactcacaaagatcctcctgactctacctcctgagtggtaggacaaaagccgtgcaccatctgatcaccctactcatgatgtgtgcatgcacacacactaataataacaagcaaaaaatatctttaaaaagtctaaaaccacaactttgagacagacattaggtagacatacttattccaaaagtcagaaataggaaagaagaaagggataaattacgccaaataagccccagacatggcagggcaagagttcgttctgtgtgcgcacgtgctccaaagtgtttcattacagttgctttcagagtcctgggtgaggggattatttgtaggagaatggactccctacaagtagttacacactcagatcttctctccctttctcaccaactatagaccccccagggaggggtggggtaacatcagctcctcccaataggggaaggttttgttgttgttgtgttgtgttgtgttgtgttgtgttgtgttgtttgagacagtctatcactatgtagcctgattggcctggaattcatcaggtagaccaggctggcatctaaatcagagattcacctgcctctgtattttgactgctgggattaaaggtatgtacaccaacatattccctaagaggggatggatcccagggtctagatgccattgctctctctcccctctctctttataaatatagttttaagatttttacttgtatttatcagtacagggggtgggttgctggagtatgccagaagagagtattggatcgcttggagctagagttacagggaattttgagacatctggggactgaatataagtcccctgaggagcagcaccccaacatggtaatacttcatcttaaggctcaagagcaaactttggctccaagttctgcctctagacacacggagcgccatttgggttcacagggctctaagcttgcctcgctaggcacgctgacacagcacttcttgtcagtcggaaccagttgctggcacctctcccaagctgtttttgcatactggtggctctatagctctggcgtcataactgagagcagtgttttcatagctcttttgggcattgctctcattgggggtctattctctgggcaaaggtcgctaagcactgtgctggtagagactttatatcagccttcctctggttctctgcttggctctcaaaactcatggaggaatcctttgaaatctaggtgaagctagtcatgactccacagctcatacgtttggaggcagcagttccttgctaaattctactttgtgtgcattaatgtctcctaagcaagtctagtagaaaatcctttataatatcaattgtagtacttcaagtttcttccgcatcacggcatcggctgagtaacagtcccccagatagatggaacaatagaagattacaaagtgagaaaaggaaggaagtagaaaaactggtgtttacttggttccagctgttttctgattcaggaagaaaggggccgggcatactctacccatttatagtaagaagatttttttgttttggtgggtttttcgagacagggtttctctgtgtatccctggctgtcctggaactcactttgtagaccaggctggcctcgaactcagaaatctgcctgcctctgcctcccgagtgctgggattaaaggcatgcgccaccatgccaccacgcccggcttgtagtaaggagatttaactgtaccatgtaaggcaagagctcctcatgtcagagttcaaaaagtaaatgtgctgaaccatcacttggtttagaacagcttaagcccccagcccccaccccaccccaaaccaacccttgactgtttaattgctgataaggaataaaagccctttcctataaaccactgtttgtttgtttgcaacgaaatcagagatttactatatggatatttaaaaattcagaatttgggggctagagagatggcttagaggttaagagcactggctgctcttccagaggtccagagaacccagtttcaattaccaacaaccacatacagatcacagctgtctgtaacttcagctctaagggatcctataccatcacacagatatggatgcaggcaaaaaagcatcaatgcacatggaataaaaataaataaaatttttaaaattttgaatttacaaataatgaagatccctcactggttcagccactcaccgaggtacctcactccagcaatttcccctcaccagacttattcatttttaaagtttagatgtttgaatatttattgtaaaacagcaagcacaatgatttctatttttataattggtgacgtgatctggaaaaatacttctaattggtaaggcaagagtgattgcaatgcactcttcatttttttctaacttcttaaagtatcttcttttttaaaattaaaactttattataggggctggagagatggctcagtggttaagagcactgactgctcttccagaggtcctgagttcaattcccaggaacctcatagtggctcacaaccatctgtaatgagatctgatgccctcttctggtgtgtctgaagacagctacagtgtacttagatataataaataaatcttttaaaaaaacctttactggaaggagttacagagacaaagtttggagctgatacaaaaggatggaacatctaga

SEQ ID NO: 26 - DNA, 721 bp, Homo sapiens
  misc_feature (548)..(548): n is a, c, g, or t
  misc_feature (619)..(619): n is a, c, g, or t
  misc_feature (658)..(658): n is a, c, g, or t
  misc_feature (720)..(720): n is a, c, g, or t
agtggaagacttaagatgggggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaaggttggagtgcaatggcgcgatctcggctgactgcaacctccacctcctggattcaagctattctcctgcctcagcctgccgagtagctgggattacaggcatgtgccaccgcacccagctaattttgtattttttagtagagatggggtttctccatgttggtcaggctggtcttgaactcctgacctcaggtgatccgcccacctcagcctcccaaagtgctgggattacaggcgtgagccaccgcgcccggccagaacattagttttaaacttcctaacccttgggagaaggcaaaacacttgatgaaatctacataaagactaaaacattttttcaaanaaaaaaaaaaaaaagaaaaaacatgccgcccggatttcgagctcacttggccaattcgccctatagtgagnccgtattacaattcattggccggggttttacaacggcgngacttggaataaccctggcgttacacaactaatcgccttgcagcaattccccttttggcagnt

SEQ ID NO: 27 - DNA, 2356 bp, Homo sapiens
ggaagcacactgcggcgattctggagaggttgtccttttctggcatcagcgttgcggctcgaggcaaagctggtcctgtgcctgctgtccattgccgctaaggcctgctgctgccattcaggcgtgtctctctctctctctctctttcatgccgctctctccaccccatcttgggacggccagctctaagaattcctgctacgacactgaattcaaccaggaggtgatgccacactcaatcagaaactatgctactgctgaagaggtatattgagccctgcctggttaacctccagtgaggttattagagaattgggagaggctcaaatcagcatcctgcacctagttatcaaaccattgtgaagtcttgattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggctggattgtgaaggatatttgaaaagtattttagagtccaccagatcatccatgtgagtgaccatgcagcaaaagaaggagggtcctctcagtgattaaggattatgaagtattaattcttccactgatatctcaaaaggtgatctggacaaaggaacaggtatctcaggattcctccttggtcacttttcagcagcagcctgctcttcttttgcaatctcttcaggatctctgtagaagtagagatcaggcatgaactcccacgggtgttcacgggaaatggtgccacgcatgcgcagaacttcccgagccagcatccaccacatcaaacccactgagtgagctcccttgttgttgcatgggatggcaatgtccacgtatcacagaggagaatctgtgttacacagagcaatgtagagacggggtttcaccgtgttagccaggatggtctcgatctcctgacctcatgatccacccgccttggcctcccaaagtgctgggattacaggcgtgaaccaccgcgcccggccaggagagtgtattttctacacataagttcaggtcatctccacacagacccagtttgcctccctcttttccgatctgaatgcctttaatttccttctcttgcctaactgtactggctagaacatcccgaactaggttgaatgaggtgctgagagtgggcataattggcttctttacctccgaagaaaatatttcatgttttcttcattgattatgatgttagttgtgggtatttcatttactgcctatatggtataaagatacattccttctatgcctaattggttgacagcttttattatatcaaattctataaaactgttttatttttaaatctattgagatgatcaaatggcggtgtccctcctcctttataagactatttaaaacatccttgcctcagagggacaaatcccatttgaacatggcaagtaatcctcttaatataaagtggaattaggtttgacagaaattaccagtgaagcactatgggcatatatttgataggagatttttattatggatacaatttacttgttattggtctcttcagatattctttctcatgactggatttgcgtacgttgtatgagtacaaattttttcatttattctacgctgctctttattatatgcttccttctgtaaaatttggactgtttgttcttcccattatattaatagttgcttcaggtgtaacataaggttattttttaagtacttttctggtatcacaaatattggtgttttgtgtttcatctttcatttgtcaaaatattttttaacttccatttggatttaatgattcacccattcattattcaaaagcatattgtttaatttctatgtgtttgtgaacattctaatgttcattctactaatagttcctaggttcatgcaatgtgcttaaaaatgtggtataatttctgtattattaaatgtaaaactagtcttgattcgtaacataaggcctacgcaaagatccatcttctgcagagaagaatgtagattgtgccgctgttagacgaagtattctgtatacgtcagtttgctttatttggcataaagtgtagtgtaagccagatgtagtgtaagtcagatccagatgatctgcccattgctgaaacttcagtacttaagtcccctattattattgtatggcaatctatctgtccactcagaagttattatatttgttttatatgattgagcacttctgttttgggtatatatgtatttacaattactataacctcttgctgaattaaccccttttaccattatgtaataaacttatttccc

SEQ ID NO: 28 - DNA, 3748 bp, Drosophila melanogaster
attacgttcggagtggaaaatggaaattaagtgaaatatccagtgatcgatcggtaatagtaaattgtttgatacgtttaggccagttggtaaggcaaattaacagcagttgtaagtaaatttaatcagagaccagggcaccacacccgaaaagcgtgcagatattagaagacatgggcgtagtttcatatacgagctgtccccttcggctttttcgacaagtggcagccctaatggccctcgttttttcgccgacaagcatttaatgcgtagtcaccgaagaaaagtgttagttaccagggcctgcccttttaaaattaaatttaaattgaaaaaaaaaatcaccaaaaaatcgaaatctctggcaagatgtagcgtcgaaagaaaattcatcaaacggcattgccatcatcgtgcagcaatcccaaagaagccatttagaatgcaggcatccaggcaaaaaccagaaaacgtgcctgtggcagctgcacttcgtggccttgacgagtccggacaatagaaaaaccctgggaacctaacccaaatggcttataggggttggactggactcaggtaggcgaagtccccgaaaaccgaggctacattcttgccaccgctgctaaatcgatcatcagtctttggcggcatggctaagtggaaacttctcgtaagaaactcttcccggaggagtgtggaatttttgttatattttttttaaagtgcatttttttttaaaggtgaaattagctagagtgtgtactgctactgatagggtgacctaacgcaacagcaacgagatgtgctccatcgggcagtgataacttcttggcaaccccaaccttaaaaattcgacttcaattcaatacatgtgaccagataaacacagcttcaagcgcattactcgctccatagattcattaaaccttaatgaacacaagaaacactcaaaaagtaagagattcttcgcctgagctgcaattcttaagggtggcgtcttcgaggcatcgaagacgcggctatccgaagtagcgaaagtggtgcgagtggtgcaacttgtgacactgccagcggagtggatgagccccatataaactgaaccttgcagacctacaaagaccctatggcccataaagccggacagggttttcctgtccgaaaagtaatgtaacgaaaacgcttgagatggaaaattctggccggaacgaaagagacaaatgaacccaaagcgtccgcttgtcgccacttgcgtttcgagaagacgcgtacgcatacctctatcggatgcatgtggcggtacgcggatgcgagcgagacaatgatactgtagacaaggagagacggctccctctctccatcactctctatcgggctggccaggcgtttgcatcgcaagcgggtgagtgagacggccatagggcggactgcaagtcccgaaagagagcggtaaagccatataacccctataagcaataaacgacgcatcgaaagttgcgtataacggcatgggcatccctcggaaaggaaaaagttcagaccgcactcacgaataccgctccgctctggaaagaccggccaaatctgtaagaaatgctcggccaggagcgtagaatcgccataatgcagtaaacgactgcaaaagcagctataactcaaacagaagttgacaaaagcaagagctatgcgctctattaaagtcacaataagtgtcatcgtaacgttcaccacttttcacatttcatcaaagtccatttctggtccgtgcaaagcagtaatgtagagattctttttcatttgaaattgttagttatcactgccctaggaactcatcaatttttgtgatagtagtgactgaagtatttgttttgagggaattagaagccagaagatttaggagccatgccgccgcttaagtaagatctaaaagccaagaagctacacccagaagaaactgccactgcatagatttttgaaatgagcaaagaaatctaaactgaaatggttatccaccaactgaaggccatcgaatctattaagttttatccacgttagcactgttcaaaatctcaagctaggctactaaacgaactattcatcacaaaagcctcacacaaaatattcattcatgaatcagtctagcctattttttcttctgctttaccatttgaacaagtactcagaaatcgctcgaaaagggacattttgattttgctttgattttgtgccttagtttttcaactaaccaaaatattgcttacagaaattaatcagtttattaactgaaaaagcccttaaattaactgccaggaggtgagtttttgtcttcgattcttggaaaacgttgagtaggggcccaactaaaggaaataggccagacaaagcctgtaaaaaaaacctataaaaataaaaagttctaaaagaggccactgtgaaactgttatacaagctggcctaaagttatgcgtagaagaaaacgtataaaagtgaataaatgtttgcaaacggatgtttaaaacatgcgttttctaaacgaaagatgaaaaataatatcaaaaagcgaattaagtgctgttcaatcgtttgaccagcagttgatttgcgaatggctgaaaatattcgcttaaacttatggcaaagcttgttaaaataaaaaataaaaaattttaaaagaaataaaaatatccttacaccgggcacctacaatgcgtatccacccgggattcaagcaaaagctattattctattggccttgattattaacatatttctatgctgtgtgttctttcagatgagttttgaacagagacgaaacttggagcctcgcggagccaaagttttaaattgatttttgtttttaattccctatattcgagtcgatttcccgcagtcttttcattaattttcttaaacattgactggctaattcttgaacctcagttttcattcaaaagtcatcttttcttcgttggtccctgcttgagcttgaaacattgtgccaagaatttttttctgttcaattgaaccttttctgtgcaaatgtcctgcagaagaggaaacccattacagacttgtgctttctcctgaatgtgatatgcaagcaggtgtaacaaagcctatgaaatccggtccaaccccacatcaggccatagccaagaagctccgcctaatacaagagaagattatactaaccagtttgctatctttcagatccgaccagaagtagatcgtgttctgtgaactaaccccttcagtgttcagcacctcgtcaattgttcttaattgttccttttattttatgttgtgttttatctaattaacttccgttgtattttacccagtccccttccttgactttctaataattttccatgttttgacagatccttttttgtcccacccgaataaccaaccatactattcttatataaggttcgtgtttcggaaaacgcattaaaaggcgtaattttaaatcgttttccgaaatgggaatcacatttaaacaatattttgaactgcgtaaaacgaataaatggaacggtattgaaagcctatgcattcattacggttcaagaagtataactaaaaaaaaggaatgaaaaaaaaagaaaagaaaaacacatttactaacaaataaaaacttgctgatcaacgttctacgcagttcttaaaaagatgttgaaatgaacacagccaaagcaagtaaaaatgtgtggaaacgttatacgaatcttcaccaagtgcccaaactata

SEQ ID NO: 29 - DNA, 573 bp, Drosophila melanogaster
tgttgcggcattcgcggcctggtcacactaagctagggctactttttatatcataagtcgagcgtttaggtagctcggatggccatcgaaagggtaaattggtgttacatatagctttagagatcgtttcgaatcacattgataatcgttcgaaacgttctccgaagcaaaatcaagcaagagtaacgatttccgcatagtcgaaaatgtttaagttgaattgtcttacggacagtgagatgagtacgactatttggaaatcacaaacgaattgttttcatggttgacgcgcttgtcaagctacaaaacaaaatgaatgatatacaatatacaatatacaatatgcaatacaatacaatacaagacaaaaaaatgtgtcttggaacgcaacattgtacaagtcgcaatgcaaactgaagtcttaaaagacgtgtaaaatgttgcaaattaagcaaatatatatgcatatatgggtaacgttttacgcgccttaaccagtcaaaatacaaaataaattggtaaatttcatataactagtgaaatgttatacgaaacttaacaattgccaaataa

SEQ ID NO: 30 - DNA, 2322 bp, Homo sapiens
gggagggggtgggatgggtggggggtaacgggggaaactggggaagtggggaaccgaggggcaaccaggggaagatggggtgctggaggagagcttgtgggagccaaggagcaccttggacatctggagtctggcaggagtgatgacgggtggaggggctagctcgaggcagggctggtggggcctgaggccagtgaggagtgtggagtaggcgcccaggcatcgtgcagacagggcgacatcagctggggacgatgggcctgagctagggctggaaagaagggggagccaggcattcatcccggtcacttttggttacaggacgtggcagctggttggacgaggggagctggtgggcagggtttgatcccagggcctgggcaacggaggtgtagctggcagcagcgggcaggtgaggaccccatctgccgggcaggtgagtcccttccctccccaggcctcgcttccccagccttctgaaagaaggaggtttaggggatcgagggctggcggggagaagcagacaccctcccagcagaggggcaggatgggggcaggagagttagcaaaggtgacatcttctcggggggagccgagactgcgcaaggctggggggttatgggcccgttccaggcagaaagagcaagagggcagggagggagcacaggggtggccagcgtagggtccagcacgtggggtggtaccccaggcctgggtcagacagggacatggcaggggacacaggacagaggggtccccagctgccacctcacccaccgcaattcatttagtagcaggcacaggggcagctccggcacggctttctcaggcctatgccggagcctcgagggctggagagcgggaagacaggcagtgctcggggagttgcagcaggacgtcaccaggagggcgaagcggccacgggaggggggccccgggacattgcgcagcaaggaggctgcaggggctcggcctgcgggcgccggtcccacgaggcactgcggcccagggtctggtgcggagagggcccacagtggacttggtgacgctgtatgccctcaccgctcagcccctggggctggcttggcagacagtacagcatccaggggagtcaagggcatggggcgagaccagactaggcgaggcgggcggggcggagtgaatgagctctcaggagggaggatggtgcaggcaggggtgaggagcgcagcgggcggcgagcgggaggcactggcctccagagcccgtggccaaggcgggcctcgcgggcggcgacggagccgggatcggtgcctcagcgttcgggctggagacgaggccaggtctccagctggggtggacgtgcccaccagctgccgaaggccaagacgccaggtccggtggacgtgacaagcaggacatgacatggtccggtgtgacggcgaggacagaggaggcgcgtccggccttcctgaacaccttaggctggtggggctgcggcaagaagcgggtctgtttctttacttcctccacggagtcggcacactatggctgccctctgggctcccagaacccacaacatgaaagaaatggtgctacccagctcaagcctgggcctttgaatccggacacaaaaccctctagcttggaaatgaatatgctgcactttacaaccactgcactacctgactcaggaatcggctctggaaggtgaagctagaggaaccagacctcatcagcccaacatcaaagacaccatcggaacagcagcgcccgcagcacccaccccgcaccggcgactccatcttcatggccaccccctgcggcggacggttgaccaccagccaccacatcatcccagagctgagctcctccagcgggatgacgccgtccccaccacctccctcttcttctttttcatccttctgtctctttgtttctgagctttcctgtctttccttttttctgagagattcaaagcctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagcaaaaaaaaaaaaaaaa

SEQ ID NO: 31 - DNA, 1356 bp, Homo sapiens
ttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctcccccc

SEQ ID NO: 32 - DNA, 2075 bp, Homo sapiens
ccaaatcatagatcaagatattttatttatgtatgtcttttaaatgaagagtggttaggatagtcctgattattgcacataaatattgcctttcactagattattgttttgggccaaattttagactattattttaaaaaagagtaccttagtttaatccaacctttccagatatttagaaattattgaaatgtatattttgtgaagatggtcttatgaaagttgttgagctagaaacatgtccttcaccagtggaattcttagaagctttccttgggcttcactgggtgctaatagaccatgatcgtattgctctgtatataatggtacaaattttgttttataacacttagtcttaatagaatgggaatattttatcttactaacgtagtcattagctggccactctctgtgtccattggaccttatagggtaaagggagggcagtgcgtatttgaagcctgtgcacgtgacacacaaagggcttagcaacctccgtgttttcccagcacaggatacccattcttcctgaatgtttcattgttaaattagattgtgtgtgtgtgtgtgtgtgtgtgtgtgtattttatattaacatacagatgtatgtattttagttgcattttttttcttaaaatgttattttttctctttttcttttatgtcaggtgatgatagagcccctagggaagcaaaactgtccatgcccttgccttaactttcagatacgataaaaacaacatttataaaatacctgtcttagaaatattagctaaaattatgttggggaaagtatgtttgaaaatagaattgtaagctaccacattgtgataaatattactaaatttgtttattgacttgtcaggaagcaagagaatgaattaaagaaaactccagagaatgagctgacaacctactccctggtcagtggctctccatgcctacctgtggtctcttggacacccttgcagaagatgacttcctgggaactcttctgggagtgaatgttatcagcaaattcccaaaacaacaccccttagacaaaaagcctcctcacctatgcattgcctagaccacccactaaaggtgatggccacaaagaggtggatttgttgagttggtgccattccttctactgccagcttcaccaaaacaatgacacagtcttccttccgcatggagactcttctctttcctgtgttgcagtggatgcctcctgcagataagaaatgcttaactgagaaatgctcatgttgggatatcatcgatgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacacggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttatcagttgaattactgggattaagtatgtgcacactttatatttatattttgaaaattattgcaagattgccttcaaaaatgtggttaacaactttatcttcaaatggcaatgaatgagattgccagctttcctacagcctcgacagacaatggattttataaatatttaact

SEQ ID NO: 33 - DNA, 4516 bp, Homo sapiens
atggagaagctgcaccagtgttattggaaatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaaga

SEQ ID NO: 34 - DNA, 5235 bp, Homo sapiens
gcggggagctcgcaccgccgcgcccgggccgcgagtgatgataacctaagaggccggcgcgggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagactaccaagtacacgctgctgtccttcctgcccaagaacctgttcgagcagttccaccgcccggccaacgtgtactttgtcttcatcgcgctgctcaacttcgtgccggcggtgaacgccttccagcccggcctggcactggcgccggtgctcttcatcctggccatcacggccttcagggacctgtgggaggactacagccgccaccgctccgaccacaagatcaaccacctgggctgcctggtcttcagcagggaagaaaagaaatacgtgaaccgattctggaaagaaatccacgtgggagactttgtgcgtcttcgctgcaacgaaatcttccctgcggacattctgctgctctcctccagtgaccccgacgggctatgccacatcgagaccgccaacctggatggagagaccaacctgaagcggcggcaggtggtccgcggcttctcggagcttgtctccgaattcaatcctttgacgttcaccagcgtgatcgaatgcgagaagccaaacaacgacctgagtaggtttcgcggctgcatcatacatgacaacgggaaaaaggccgggctgtataaagaaaacctgctgctgaggggctgcacccttaggaacacggacgcagtcgtcggcattgtcatctacgcaggacatgaaaccaaggctctgctgaacaacagtgggccccgctacaagcgcagcaagctggagaggcagatgaactgcgacgtgctctggtgtgtcctgctccttgtttgcatgtctctgttttcagcagtcggacatggactgtggatatggcggtatcaagagaagaagtcattattttatgtccccaagtctgatggaagctccttatccccagtcacagctgcagtttactcatttttaacaatgataatagttctgcaggttttgatcccaatttccttatacgtttccattgaaattgttaaagcatgccaagtgtacttcattaaccaggacatgcagttgtatgacgaagaaacagactcgcagctgcagtgccgagctctgaacatcacggaagacttaggacagatacagtacattttctcagataaaactggcactttgacagagaataagatggttttccgaagatgcactgtgtctggtgtagaatattctcatgatgcaaatgcgcagcgtctggccaggtaccaagaggcagactcggaggaggaggaggtggtgcccagagggggctcggtgtcccagcgcggcagcatcggcagccaccagagtgtccgggtggtgcacagaacccagagcaccaagtcccaccggcgcacgggcagccgggccgaggccaagagggccagcatgctgtccaagcacacggccttcagcagccccatggagaaggatatcacgcccgacccaaagctgctggagaaggtgagtgagtgtgacaagagcctagccgtggcgaggcatcaggagcacctgctggcccacctctcgcctgagctgtctgacgtctttgatttcttcatcgcactcaccatctgcaacacagtcgtcgtcacgtccccggatcagccacgaacaaaggtgagggtgaggtttgagctgaagtccccggtgaagacgatagaagacttcctgcggaggttcacacccagctgcctgacctcaggctgcagcagcatcgggagcctggccgccaacaagtccagccacaagttgggctccagcttcccgtccaccccgtccagcgacggcatgcttctcaggctggaggagaggctgggccagcccacctcggccatcgccagcaacggctacagcagccaggcggacaactgggcctcggagcttgctcaggagcaggagtcagagcgcgagctgcggtacgaggcggagagcccggatgaggccgcactggtgtatgcggccagagcctacaactgcgtgcttgtggagcggctgcacgaccaagtgtcagtggagctgccccacctgggcaggctcaccttcgagctcctgcacacactgggtttcgattccgtccgcaagaggatgtcagtggtgatccggcacccgcttaccgatgagatcaacgtctacaccaagggggccgactcagtggtcatggatctcctgcagccctgctcttcagttgacgccagagggaggcatcaaaaaaagattcggagcaaaactcagaattacctcaacgtgtatgcggcggaaggcctgcgcaccttgtgcatcgccaagagagttctgagtaaagaagagtatgcctgctggttgcaaagccacctagaagccgaatcctccctggaaaacagcgaggagctcctcttccagtctgccattcgcctggagaccaacctgcacttgttaggtgccactgggattgaagaccgcctgcaggacggagtccctgaaactatttctaaattgcgtcaagcgggcctgcagatttgggttctcactggtgacaaacaagaaacagctgtcaacattgcatatgcctgcaaactgctggaccacgacgaggaggtcatcaccctgaatgccacctcccaggaggcgtgtgcagccctgctagaccagtgcctatgctacgtgcagtccagaggcctccagagagcccctgagaagaccaagggcaaagtgagcatgaggttctcctctctctgcccaccctccacgtccactgcctctggccgcagacccagcctcgtgatcgatgggagaagcctggcctacgctctcgagaaaaacctggaggacaaattcctcttccttgccaagcagtgccgctccgtcctctgctgtcggtcgacgcctctgcagaagagcatggtggtgaagctggtgcggagcaagctcaaggccatgaccctggccataggtgatggagccaatgatgtcagcatgatccaggtggcagatgtgggtgtgggaatctccggccaggagggtatgcaggcagtgatggccagcgactttgcagtgccgaaattccgatacctggagaggctcttgattcttcacgggcattggtgctactcccgacttgccaacatggtgctgtacttcttctacaaaaacacaatgttcgtgggcctcctgttttggttccagtttttctgtggcttctctgcatctaccatgattgaccagtggtatctaatcttctttaatctgctcttctcgtcacttcccccgctcgtgactggggtgctggacagggatgtgccagccaatgtgctgctgaccaacccgcagctctacaagagtggccagaacatggaggaataccggccacgaacgttctggtttaacatggccgacgccgccttccagagcctggtttgcttttccattccttacctggcctactatgactcgaacgtggacctgtttacctgggggacccctattgtgacaatcgcgctgctcactttcctgctccacctgggcattgaaaccaaaacctggacctggctcaactggataacgtgtggcttcagtgtccttttgtttttcaccgtggctttgatttacaatgcgtcttgtgccacgtgctatcctccgtccaacccttactggactatgcaagccttactgggtgacccagtgttttacttgacttgcctgatgacgcctgtcgctgcactgctgcccagattgtttttcagatccctccaggggagggttttccccacacaacttcagctggcacgtcagttgaccaggaagtcccccaggagatgcagtgctcccaaagagacctttgctcagggacgcctcccgaaggactcgggaaccgagcactcatcagggaggacagtcaagacctctgtgcccctgtcccagccttcttggcacacacagcagccggtctgctccctggaggccagcggggagcccagcacagtggacatgagcatgccagtgagggagcacaccctgctggaggggctgagcgcaccggcccccatgtcctctgcgccaggggaggctgtcctgaggagtccaggagggtgtcctgaggagtccaaggtgagagctgccagcaccggcagggtgacccccctgtcttccctcttcagcctgcctaccttcagcttactcaactggatttcctcctggtcgctggtcagcaggctggggagtgtcttacagttctcccggacggagcagcttgcagatggacaagcgggacgtggacttcctgtccagccccactcaggccgatcaggacttcaagggccagaccacagactacttataggagcatcttcaaggcggtcacagtgaaaaccttgaaatggccttttttaatatatataaataaatgttaatattatttatgtttattatttgcacagaagagttctagggagatgtatttctaaatgtttcccaggctaatacaggaaacaagaggtaccaaaaaagaaagtttattttttaaaattctaagtagagtatattgaaaagaaaaagaagagccttaacatatataaaagtttaaagaagagtaacacttgaaaagtgtgtttagatttattttttcatctcatttttaagaacaagcagtacgatttgttttcttcaacatgtgtgactgcgcactgagtacaaatgtgtgactgctcatggttaatgcaggcaggtgtgaacatgggggaacaatgagcagagatggcagagggcagagcacatggcccccagaggcttccagtctcactgacacaggagggctgggctccacttcatccagatgaaggaaaggaagacctcaagaaaaattcacagttgagtgcatcccagcattctgttccgggcaggcatttcaggaagaccgccttgtaggtattacatccctggtgtcgtattttgcctgttaaatcgtaacaagcaataaacaactttcactttgcaaa

SEQ ID NO: 35 - DNA, 1167 bp, Drosophila melanogaster
aagttttggctccaaattaatagacctccatggacttctcaaagagttgcgacaggttttcctgcgtctgcgccctgggtgctagcttagtgatcctttcctggggcagggttccctccaccaaggcgggtatatcgctgctggagaatcccagctctcggaggccattttctatgcccgcgcgttgcataaaaccgcgtacagtgtccgccaaaagacgaccggcgtctgctttttcgacacctcgcacttctgcgcccagcaactgggcagcctccaaatgccgatccggacaagctggagcagtgaactcaaagaccgccggagcactgatcaccacggataggccgtgtggaataagagcgtgatccgcggagtagccctttggcttgtaatccctcacatttccagaaataggataggaaaggccatgacacaggtgcactccggcattaccaaatcccacgccagccattgtggaagccaggtgcatctgggatcgggcttctaggttatcgggctgctttgaactacaagaagacccgaaaatgtgcgactaccagatggagtactcctttatttttgaagacagctcctgcgagggcgatgcctcgatggcatcctacgacaatggattcgagtccatgtggcatcaagtgcgcgaggagttgcaaagggagcgggagatgaatgagctctgccaggttttccagcaaaacttgagcctgagtccgccggtcatcgcggatagatggagattctgactggacctcccaaaagccaacttattgtgatatttgtaaattatagttttagcagttcgtttgccacatgagtggaacatcgtgaatgcacttttgataagtgctcggttattttatattgtaactaccagccttcagaggcgatcgtatgcatagtttcttgaagtcaatttgtccgtgtattcaaatgtttgctttcgtgaaaactcgcattgttttgtcactctaccaagtaatcaatttgtaccaatcaatcgcatatggttgtcctagatctaaaaatggcaataatttgccttcggtattgcacctaatgtattcaagaacaagtagggaagctcgaaatttctcaaatacttacccaaaaaatagatagaaatatattttcgattcgcaatcgttc

SEQ ID NO: 36 - DNA, 332 bp, Homo sapiens
ggatgtgagggcgatctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagtagctgcgctcccctgctagaacctccaaacaagctctcaaggtccatttgtaggagaacgtagggtagtcaagcttccaagactccagacacatccaaatgaggcgctgcatgtggcagtctgcctttctttt

SEQ ID NO: 37 - DNA, 1457 bp, Drosophila melanogaster
tgttgagtcaacagctgtagatacaccaattgttgccgatttctttcttttcgactgtcggcttctcgcgaaactgtgattgtgaaaattgtacaaatagaggcaaatttaaccatggcgcacatgtcccatatgctccagcagccttcggggtcgacgccctccaacgtgggctccagctcatcgcgcacgatgtccctgatggagaaacaaaagtacatcgaggactacgactttccctactgcgacgagagcaacaaatacgaaaaggtggcgaaaattggccaaggcaccttcggagaggtttttaaggctcgcgagaaaaagggcaacaagaagtttgtggccatgaagaaggtgctgatggacaacgaaaaggagggctttcccatcacggctctgcgagagatccgcatcctgcagctgctaaagcacgagaacgtggtgaatctgatcgagatctgccgcaccaaggccaccgccacgaatggttacagatccaccttctatttggtctttgatttctgcgaacacgatttggcaggtcttctgtccaacatgaacgtcaagttcagtctgggcgagattaagaaggttatgcagcagcttttaaacggtttgtattacatccacagcaacaagatcctgcaccgagacatgaaagctgccaacgtgctgattaccaagcatggcatcttaaagctggctgactttggcttggcccgtgcttttagcattccaaagaacgagagtaagaatcgctataccaatcgcgtagtaaccttgtggtaccggccgcctgagctgctacttggtgaccgcaactatggtccacccgtggacatgtggggagccggctgcataatggccgagatgtggacacgctcgcccatcatgcaaggcaatacggagcagcagcagttaacctttatttcgcagctatgcggctcctttacgccggacgtgtggccgggagtggaggagctggagctgtacaaatccatcgagctgccaaagaaccagaagcgtcgagtcaaggagcgcctgcgtccgtatgtcaaggatcaaaccggctgtgatctattggacaaattgctgacccttgatcccaagaaacgcatcgatgcggacacagctctgaatcacgacttcttctggacggatcccatgcccagcgacttgagcaagatgctgtcccagcacctgcagagcatgttcgagtacctggcgcagccacgccgcagcaaccagatgcgcaactatcaccagcaactgaccaccatgaaccagaagccccaggacaacagtatgattgaccgggtttggtagactgccagaggtgtacgcacccgactaatagtttctcaccttcaactagcgttaggttattaggttagtgtacaataaaaatattggcatttgcattagcgcttgctccaaatataaaaaaaaaaaaa

SEQ ID NO: 38 - skipped

SEQ ID NO: 39 - DNA, 1757 bp, Mus musculus
gaattcctgcagcccaattcggcacgaggctagctgaagctgctgaagggtccttcgttgagctgccgtggtctccgccgccttatggcggcgatcggcgtgcacctgggctgcacatcagcctgtgtggctgtctacaaggatggccgggccgatgtggttgcaaatgatgcaggggatagagtcacaccagccattgttgcttactcggaacgtgaacaggtggttggactggcagcaaaacaaagtagaataagacatgtttcaagcacagtagtgaaagtgaaacagatccttggcagaagctctgcagatccacaagctcagaaatacatctcagaaagtaaatgcttagtcattgagaaaaatgggaagttgcggtatgaaatagatacaggagaagaaacaaaacttgttaatccagaagatgttgccagactgatattcagtaaaatgaaagaaacagcgcattctgtcctgggctcagatgcaaatgacgtggttgtcactgtcccatttgactttggagaaaagcagaagtctgctctgggggaggcggctggagctgctggatttaacgtgctgcggctgatccatgagccgtctgcagctctccttgcttatgggattggacaagaccaccctaccgggaagagcaatgttttggtgtttaagcttggaggaacgtccttatcgctcagtgtcatggaagttaacagtgggatgtatcgggtcctttccacaaacaccagtgacaacataggggggggacatttcacagacaccttagcacagtacctggcttcggagttccagaggttgttcaaacatgatgtgagaggaaatgcccgagccatgatgaaattgatgaacagcgctgaagtggccaagcattctctgtcaaccttgggaagtgccaactgctttgtagattccttgtatgaaggtcaagactttgattgcaatgtgtccagagcaagatttgagctgctctgttctccgctttttaacaaatgtacagaagcaatccgggagctcttgcgccagactggattcacagcagatgatatcaacaaggttgtgctgtggcacgagggtggatcttccagaatcccaaagctgcagcagctgattaaagatctcttcccagccgtggacctcctcaactctatccctccagatgaggtcatccctattggtgcagccatagaagccgggattcttgttgggaaagagagcacgtcaggagatgactctgtcatgatagagtgttcagccaaggatattttagttaagggagtggatgagtcaggtgccgacagattcacagtactgtttccctctgggaccccgctgccagcccgaagacagcacacactgcaggcccccgggagggtgtcttccgtttgccttgaactctatgagtctgaggggaagaactctgctaaagaggaggccaagtttgcacaggttgtactccaggacttagataaaaaagaaaatggattgcgtgatatattagctgttcttactatgaaaagggatggatctttacaggtgacgtgcacagaccaagacaccggcaagtgtgaggccattactgttgaggttgcatcctgactcttcagataaaccaagatggtttttagaactataatatcaacataatttggttttgtgtataagtgttgtttataataaactgctttttcaatgaaggtataagctatgtttctattaaaatacaatttattact

SEQ ID NO: 40 - DNA, 166 bp, Mus musculus
aaggagttggggatttagctcagtggtagaatgcttgcctagcaagcgcaaggccctgggttcagtcctcagctctggaaaaggaaaaaaaagacaaaataaataatttaggaagtatatgttaattgagggaaagaatataagtaaatcaaattacatcattatt

SEQ ID NO: 41 - DNA, 200 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaacaaaagacaaaaaaaaaataagcgtaacttccctcaaagcaacaaccccccccccccttt

SEQ ID NO: 42 - DNA, 53 bp, Homo sapiens
tccattcagcaccttggacagagccagcggatttgtccgaggtggtagtactt

SEQ ID NO: 43 - DNA, 3343 bp, Mus musculus
gagctgcagctgcagtacaactgcatgctgaaataggagactgctagacagaccacactggcacctgaagcacccgcgaggaggaggacaaaaatcgagtttccacatttgaaagtgaacctgccagccccaagaacgtgccaaatccagttgcaaggacctggccctgcatgagacccctctcagacctctcagaatggctcctgcttccaggtcctcggaggccctaccctaggactgagctctgaagcgtcccagtgaagccagaggctcctcattcttggaccccggtcctgggaaacagaatggccgcatttcagcagctacaggccctgacttgttttctgttgtgctttttcttctcttactgctcttgaaggccattcccagccgccgccactgtcgttttttatagtctgatgtgacatttttccacaccagcaaaggtctcctgctaagcactgtgctatgcgctgagatggtttaggaagccagagtgaagcacgttctcccagcgggagtttaccggccacaaactgaaacactcataaatctatcacaaagcgaaaaatctctaaaatccaaagactagaggagtataaggtttcagactttggttttaaaataatagggggttggggacaacagccaacacctgttgacagtctcctgcaaggcctcacctgggaaggggagaaacggctcaggcaacaaaaacagctattcctgggtcaaagtgacaacccaaaaaatgccacagacacaagcaatgcctggtggagagagctggaagacagcgtggactcagtggagaagggctttctggggaagggatgccagagattttgtccctgtaggctcctgggagtaggatggtttccactactcaaatgccccacaaccatctctaaacaacccagtagggttcacagtgttctacggatggggacacagtggctcagagggtgttgcccaaggtcacagagctaaagaaaatggctggactgccaatgaaaccatgctctttctacgacaacatgttacccaaggaactgcacaaacacaaaagtgttcacttctgtccaagccacccatttgatcaatacgacgccagcctaccagcctatatgatgagtttccctcatgggccatccccagccctcacagagcataatgcactagacaagccaaaaaaaccaaaacaaaatctgtcatagaagtctaaggaatctcaactccccgagttcccgcggcgtagctttaaagtgcgcgcagctcggcggcatatggcaaatcaattactagtttaaatcttaaaacaaaaacatggcaaatgcagcacggaaataatcaggtacaatggtgcagctcggattacagcggccactggagttttgaatacaattaatcatcgttccaggcaatgggaagccatattgacacttattcctaatttgaatatttaattagggtgaagttcttcatcaaattatcgtagaactgggagaaagcctggaagacttacacaattaccaccttaaccccttcccagctgctccctgcccgagaacactctggctctgcagggaggaggaccgcctgctctgttctgccctgattctgttgggggtgggggtgggggtgtatggaagagttaagattgagaggagaaagccaaagagcccagcatgtgacccaggcctgcagtgacttgagatggagatccagatgagccttggagaagagctgcatgctgggtgctggatgccgatggagcaccaactacaacaggtctaccctacccccactcaaccctccccagctgcttagaggagagacagaggcttggaggagtgctgagacctgccccaagtcagcccagttactcatcacccagcagctccctcagcagctccctcagccagtggctggttcatccgctaatcaacacggactctcagcccacttgtgagactttgtgatgccctgctgcagccttgggcatatattcactctgtaaccatgtccatgtaaaagaaacgtagacatgtgtgtgtgctgtgtgatatgagagttatcattagtaattaagataggaatgagagagcttgcatttgccttggtcaagctactacggacggtgggtttatgacaaattgccgtcatcagaactgctcagtaaattctgacattgtgagaagttacaagctgctcctctgtctttctggtgtagtgtgctcacggcaccctccacatctggctttcatgttgaactcaggtctgtatgcgtgcatgacaagcacttaatgggccgagctctgtggtcagcccccttgaaaacactttggttggctttcattacattctaccccagagattatgtaacgggaagtaaggctcccaccgccaagccatgtcttctcatcatcctcactcaggcttatgccctcttctgagctccatgcacgtgctcagacacagcgacagactgacagagccacagtggcaaacgtttcctaacagattcaaacggcttagcaccctctttggaaggacatcctacctccttctacaatggccactcagcaggacagatggaaacaccacactgtctttctcaaggcagcctccccactgacctcctgcctatatctggtcccagcaggacaccctgggtctctcaggcctgctcttagcaagctcctgatgggagcaaatggcaccaggaactttgaaactttcctttgtatattacattaatccacataagaaaatctcttttaatgaggagtgatgtagtcacaaactctccagagccataattagagcaaactaattgaagttgtgttttgacacactttccaaattcacgggtgctggatgacatattcacaaaactggtgccgcacaaccatggcgacggcagaatcattaggctaataacgcttatttgcattcttctcatgccgccagctctcccttaaatactgtttctaccactgctcctttactgtaactttccactcgacggtattaacagtaattattagtgctttagtggaattttaatgttaagaatcacggcgcgattggcatgcactgaatgccaatgttgtctcttaactgccacccatctgcaggcttggaggtgctccctcggcccccagccccagggtgcccagataccatctttgcagcatttatgacaactgctcagggtccacacccagggagagctgaagttcggcttctttatttactgcttcaaatgcttgaagagaaaatctttcttctctccccttctctcttgtaagaacaataaaatgcaatagacattttttcc

SEQ ID NO: 44 - DNA, 3254 bp, Homo sapiens
agcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgagctgatagacacacaccttagctggatacaaaacatattatgaaacagaatgactgtgatctttgatccgagaaatcaaagttaaagttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctcta

SEQ ID NO: 45 - DNA, 3029 bp, Homo sapiens
gaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcagctcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtcctgttgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaagtgtgttgcgtcatctgttttcaaccagattgcatttatggacttttcacacactcattttgaggaccccaggttcaaaagtaaaagcactggccctgctttggggtccaagaataggagtgatgggtgaagggacctaacctggccaatagccctctgccccacacatgggatgtggatccttgacgtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgaaaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctgggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaatt

SEQ ID NO: 46 - DNA, 2794 bp, Homo sapiens
gggagtgttgagggggcctgaagggttccgctcctcccacccagggaaccgccatgccactagtgggctgtcctggagactcggggagaaagcacacaggctgtcgggaaaggtgggtcgcaggcgggcagggcagccctgctgtactgatgggcaggcgctgggtgggtggaaggcaaagccatcaggtcatccccctctctgtccctgcattgggccaaccaggtgtgtcaggaggatatttgaccattcctgagaggcacattctctctctctctctctctctccctctctctctctccctctctctctccctctctccctctctctccctctctctccctctctctccctctccctctctctctccctctccctctctcccccctccctctccctccctctccccctctccctctccctctctccccctccctctctctccctctctctccctctctctccccctctctctccctcctctctctgtcacacacatttgcacatcctgcagtgtgaatggagtatgaatgtgtgtggtaggcgacagctgtgtgtgtacgtccgggtgcgtgtgtgcgtgtgtacatgtgagcgtgtgtgcacgtgagttagagcctgagtgtcccctgcgtgggttagtgtgtgcgcccgcccggtgccctccgtcttgggagtctgggctgctgctccgcgggctctggagccggcgctccccacgagcccggactctccgccgcgcccgggagctgcgcaatcggctgctaagacgccggcgccaccggctgggccctgttctcccctctcttttctacagtcttacccgcagctgacagggttcgaaagagcatgaaacggaggagacgttacagcaacgtgtcagctgaaatgatgggcgtagacgcacgtcagcggcggaaatggtttctatcaaaatgaaagtgtttagagattttcctcaagtttcaaatgaggcgaatcccgttttccgcgatgctgcagcgcgcgggttttaaccgcagggtcacgcggaacgccgcgccgcgcgactgtgcctcggtctctgcgcccggctctccctccggtccgcaagaggaggaaggcccgcggcgtgccgaggtcagcggcgcggagccaccaggcgagacggtcacggacgcctgaaccgaggtcaccgaggccacggggccgggaggccctcagcagagcccgggggctccgcacctcaaggccggccaggaagaaacagcagcaggagcccagggcgccccggggagcccccgacacgcgggccgagcgcccagagcggcccaggccctcgcgaggagaccggcctccccagggcggggcttccgactcgggcgcccgtgagccccggaggcggcgcgaaggggcagagtccgcgtttctaaccagcccccgggtgggcggtggcccgcgcggcacggtgggcgcgagcgccgtgggctggggccggcctgggctttcagggcgagggctttccgcgccggccccagcccacccggccccgctgcgcgcccctcacgctgcagcctgggaacctgggccgggagctgcgggccgctccggggaagcgggcctgacctcccctccccaccgccgcccctgcggtgagatcctgcctgccggggcgcaggggcccgcggttgggctccgggagacggaagaggccccacagctcgggccccacgcagtggacgctgccacttaattttggcgtaattgatgtcaaggcgggtgcccgggcccccagtgaaatgcctcatgaactcgctgcgaggaacggcgctccacgcggtgcacggtggccaatcagagctgccgcttctgatggaggctgagccggctggggaggcgtcttggccaagaaccagccccagcctcgctcagggccccaacccgcagaccatgtaattaagctgcgttctgcagccagggcaagagtctcagctctgaacatcttcccgcacctctgaggagccaggcctggaaaccctctaaaatagatttttctgcctcaagacagaagatgggcgttccaggcagagaagagctgcccagtcacgtgctctgctccacctggtcagagacccttgacctttagaagactggacctgagggcgtggctggtggacctgagggcgtggatggtggacctggccacccagctgtagctttttgggttcctgtggtcccatttcttgggtcaatctcacacctggcagctcccaggaagacacccccaggcccctcacactcctgggggcagctggaattggcttcagggcgggaccaggggccccatgggtgtttggaatccctgatctgggtcaggcaccggcagcaggattccagcctggcctggactctggtgtgtcccgtttgaagaaaccccgccctgtgaaagttcaagtttagcatccaatgacccatttaagaggtttgctgagccacgtcacaggagggtctgggtgcaaacggaggtggcaacacacagagcgagccttgagcacccaggttacccccaggacctccagtctggcttgggggctcctgctgtcctgtggagcagccccctgggatcagggacggggctgagctggagagtgtgcaggattgattaatgatgtctgccacggtcaggccaactgctgtgtttctggggcccacaagctaaaaatggttggaaaaaaatcaaaacattaatatttgtgacatatgagaatgctatgaaagtcaactttgctatccataaataaagttttattgacat

SEQ ID NO: 47 - DNA, 896 bp, Homo sapiens
gtgaccctgcggttaaaacccgcgcgctgcagcatcgcggaaaacgggattcgcctcatttgaaacttgaggaaaatctctaaacactttcattttgatagaaaccatttccgccgctgacgtgcgtctacgcccatcatttcagctgacacgttgctgtaacgtctcctccgtttcatgctctttcgaaccctgtcagctgcgggaaggaacttctaaactaaaagctggcaagactcagcagaaaaaaaatatcgaaagctgcttctgctgccccagcttcactcaggccctggctgctccttcactggtctacactgctgcctcctggaaccacccactctgcaaccaggtctgatgcccggtgtggacattcagggatgaggtcccctggggctaaatgaatgaacagattctgaaaagcagaagctacgtccgggggtctctgggccacaaatcactttctgacctgcagccgtgaggcgtgaggctcactcggaagctcccggaacctggagactgccctcactcaacacttgaacaagcaaggggccaggttcaatgaaacacctgcccgcccggcacaccaggctcaaaagcaagcaagcaagcaaacaaacaaacaaaatcaaatcaggccttcacaactccccaaatcatgtgtgagtttctacagagcagaagccaaaaatatatgttatctaactaggtcctatttacatatatttttatggctgctctaaaaaattatcacaaacatagcggcttcaccccgtttcccctgttgtgattattacacattggatgcctgtatcaaaatatctcatggaccccataaatagcaacaccctgtatgtactcatgacaattttttaaaaaagaacacttacactttc

SEQ ID NO: 48 - DNA, 5688 bp, Macaca fascicularis
ggagctccaacctccgcttagagctcgctgcggccgtcctgccccgtgccctcggagacctggaccgtaccacgatgtggaaacgctggctcgcgctcgcgctagcgctggtggcggtcgcctgggtccgcgccgaggaagagctaaggagcaaatccaagatctgtgccaatgtgttttgtggagctggccgggaatgtgcagtcacagagaaaggggaacccacctgtctctgcattgagcaatgcaaacctcacaagaggcctgtatgtggcagtaacggcaagacctacctcaaccactgtgaactgcatcgagatgcctgcctcactggatccaaaatccaggttgattacgatggacactgcaaagagaagaaatccataagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgactctcgcctggactccagcgaattcctgaagtttgtggaacagaatgaaactgccatcaatattaccacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagactgaggtggactgtaaccgctgtgtctgtgcctgtggaaactgggtctgtacagccatgacctgtgacggaaagaatcagaagggggcccagactcagacagaggaggagatgaccagatacgtccaggagctccagaagcatcaggaaacagctgaaaagaccaagagagtgagcaccaaagagatctaatgaggcggcacaggatagtgtctggagcccagcatcttctcttccacttcagcgctgagtccagtatacacgagtgtctgctacagtcgccaaatcaccagtatttgcttatatagcaatgaatttcattttgtttatttgttttgcaataaaggagatgaaggtggctggctaggaggggaagggccacagccttcatttctaggagtgctttaagagacactgcaaacggtgctctggggccgtttagtaaggaaactgcatcacgattgaaagaggaacaaacccaaatctgaacctcttttgagtttactgcatctgtcagcaggttacagggagtgcacacaatgccagagagaacttagcagggtgtccctggaggagaggtttgggaagttccacagagaggaacgctctctgcttccagcctctttccattgccgtcagcatgacagacctccagcatccacgcatctcttggtcccaattactgcctctagatacatagccatcctgctagttaacccagtgtccctcagacttagatggagtttctgggagagtacacccaaatgatgcagatacttgtatactttgaggcccttggcaacctaaccaaattttaaaaatacttttgaccaaaggtgctatttctctgtaaaacacttttttttttttggcaagttgactttattcttcaattattatcattatattattgttttttaatattttattttcttgactaggtattaagctttttttattatttttcaatagtcccaccacttcataggtggaaggagtctggggttcttcctggtgcaggggctcaaataacccagatgcccccaccctgccacatactagatgcagcccatagttggccccccagcttccagcagtccactatctgccagaggagcaaggggtgccttagaccgaagccaggggaggaagcatcttcataaaaaactttcgagatccaaacattaatttgtttttatttattctgagaagttcaggcaaatcagtattcccaaggatggagataagtacagccaagcgggcttaggatatcccagcctaccaatatgctcattggcctacaactaactaggagagtgagttggccctgtctctcttcctttttctggacctcagtttcctcagtagctggtaagaatgcactagccttttgatttgataagttataaattctgtggttctgatcattggtccagaggggaaataggttcctgtgatttttccttcttctctgtagaataaatgaaatctcgttgttagaacaagaaatgtcagatggccaaaaacaagatgaccaaatttgatctcagcctgatgacgctacaggttgtgctgtgatacagagtcctcatgggtaaagcagaaagagagtgggaaagagaaccaccccactctgtcttcatatttgcatttcatgtttaacctccggctggaaatagaaagcattcccttagcgatgaggataaaagaaagtttgtaattcaacagggggaagaaaatggagatttaatcctaaaactatgacttggggaggtcagtcatttacagttagtcttgtgtcttttgacttctgtgatagttaaccccactcactaccctgtttaagatgcatttggaataccaaagattaaagccttgacataagatctcatttgtagaaagtagattaaagaccatcagaaggaaattatttaggttgtaatgcacaagcaactgtgagaaactgttgtgccaaaaatataattccttctagttttccttgttcttatttgaaaggagaaaatcccactttgttcagcattttaagcttttgtgtatcaatcccatctaaaaactctcttcaaactccacttgttcagtctgaaatgcagctccctgtccaagtgccttggagaactcacagcagcatgccttaatcaaaagttttgccagcccttggacactatgggaggagggcaagagtatcagtttgttaaaagcaaaaaaaccacagtgtctcttcactagccatatttagaacagtggttaccatccaagactactctatcctgcaacactgaactctcaagagcaaatccacattcctctgcttctgtgtaaatagggcagctgttgtctatgccatagaatcacatgatctgaggaccattcatggaaagctgctaaatagcctagtctgggaagtcttgcataaagttttgcatgaagcaaacaggattaaatcaggtttggttccttcagccctctaaaggcatagggcttagcctgcaggcttccttgggcattctctgtgtgtgtagttttgtaaacactatagcatctgttaagatccagtgtccatggaaaccttcccacatgccgtgactctggactctcagtttttgaaagcagggttcctctgcctgctaacaagcccacgaggaccagtctgaatgtctttcctttacacctatgtttttaaatagtcaaacttcaagaaacaatctaaacaagtttctgttgcatatgtgtttgtgaacttgtatttgtatttagtaggcttccatattgcatttaacttgtttttgtaactcctgattctttcttttcggatactattgatgaataaagaaattaaagtgatagttttattggtttcctttcccccaattaaggccaaataaagttgtgagaacattacccatttacttcctaagagtggattggagtttcaggagccttacaaaggactgaagagtttctcctgggactgcagcttggatgggaagtttactcggggactggcagaacaagtttctttgaaaggatcatggatgatgggtctggagtagaaggtgatgacaagtcagagagtgtcttagtcccttcaggttgctataacaaaatgcctcagactgggtaattatagacaacagaaatgtattgctcacagttctgaaggctgggaagcctaagattaaggtaccaacagatttaatgtctgataagggcttgttgaagcttgtctgcttcaaagaatgcaccttcttgatgcatccccacatggtggaaagggtgaacaaactcccttaggcctcttttataagggcacgagggttaaacttttgatgacctaatcatctcccaagagcctcacctctcaataccattgctttgggggattcaattttatcatgaattttggggggacataaacattcaaaccatagcagggtgcattcctgtattgggaagatgttaaattaaatgacttctaaatcccccatacgatttaggagactaaatggcatcctgtgaggctgactgcagtggcctgtgagaaggcaaataaacatgggaaggtagtacagggaacatggaatcgttgccagggacaggctaaataaccttaatggcacttccttgatacacacattccatggggataaacatttccaagtgggctgaatgttggctggttaaaacctcttctgctccatcttggggacacatgactaatgttttccaacctgccattttcatatgtatcgtgcactctccacccccaataattctgcctcccaaaagagcatatagtcgatgaggtttaaggtttcttcagttcagtcatgtggaagtgttgctatcctaaaattatagctggatcactttgattggatttgggatataacccaaatactaatcaaatattaaaaggcaatcttttttgttacgtgattgctacagattactgatctcatttgtcacagtttgattcttcaaattttcattctcagaagggaatcttaaacccagtttgaagggtaccttgtccacaaccacttttaaattttggctaactactcccaaccttctactgtgttctgggaaaactttttctgctgttatgtatgtattcaggaagtgcaacattattaaaataacctaaactaagcataattcagaagttaagtttcctttcatcaaaatttaatattatgaattgtgcagagaagtatgttactttgatccactttattttagaacttctttatcaagttatcagtcctcttgaactatttctgaaataaggggaaggaaggaagggaaaaaatatgaatgtgtagatagatctaagcagatgccctcagagccctggaataatcctagccgggatgtgggacatgaaaacaactctggcctactgctgctgggggctgcttcatggtgtgacataggaagtaaaatgttgctgtatgaataggaaggagggtcttcctgtcaatgagaattaatgtttttctaatgatttaacttttttactgaagaaataatatgtatacgtggtaaaaatccaaattgtatcaaggaaaatacagtgaataaaaccatcctcttagagggtatgtccatttataaatttgcctatgattgcctatacagtcaaagaggttgcaccagtatgcatgcctgccgaaagtacataaactgagcatatctatttccctacatttttgcaaacattacaccttcaagttttttggcctctgatagaggaaaaatggtaactccttgttttattttttatattcattattccttttgtaagattaaatctcttcccatgaaaaattaaaaaaaaaaaaaaaaaaaaaaaaaa

SEQ ID NO: 49 - DNA, 3735 bp, Homo sapiens
agaagaaatagcaagtgccgagaagctggcatcagaaaaacagaggggagatttgtgtggctgcagccgagggagaccaggaagatctgcatggtgggaaggacctgatgatacagaggtgagaaataagaaaggctgctgactttaccatctgaggccacacatctgctgaaatggagataattaacatcactagaaacagcaagatgacaatataatgtctaagtagtgacatgtttttgcacatttccagcccctttaaatatccacacacacaggaagcacaaaaggaagcacagagatccctgggagaaatgcccggccgccatcttgggtcatcgatgagcctcgccctgtgcctggtcccgcttgtgagggaaggacattagaaaatgaattgatgtgttccttaaaggatgggcaggaaaacagatcctgttgtggatatttatttgaacgggattacagatttgaaatgaagtcacaaagtgagcattaccaatgagaggaaaacagacgagaaaatcttgatggcttcacaagacatgcaacaaacaaaatggaatactgtgatgacatgaggcagccaagctggggaggagataaccacggggcagagggtcaggattctggccctgctgcctaaactgtgcgttcataaccaaatcatttcatatttctaaccctcaaaacaaagctgttgtaatatctgatctctacggttccttctgggcccaacattctccatatatccagccacactcatttttaatatttagttcccagatctgtactgtgacctttctacactgtagaataacattactcattttgttcaaagacccttcgtgttgctgcctaatatgtagctgactgtttttcctaaggagtgttctggcccaggggatctgtgaacaggctgggaagcatctcaagatctttccagggttatacttactagcacacagcatgatcattacggagtgaattatctaatcaacatcatcctcagtgtctttgcccatactgaaattcatttcccacttttgtgcccattctcaagacctcaaaatgtcattccattaatatcacaggattaacttttttttttaacctggaagaattcaatgttacatgcagctatgggaatttaattacatattttgttttccagtgcaaagatgactaagtcctttatccctcccctttgtttgattttttttccagtataaagttaaaatgcttagccttgtactgaggctgtatacagccacagcctctccccatccctccagccttatctgtcatcaccatcaacccctcccatgcacctaaacaaaatctaacttgtaattccttgaacatgtcaggcatacattattccttctgcctgagaagctcttccttgtctcttaaatctagaatgatgtaaagttttgaataagttgactatcttacttcatgcaaagaagggacacatatgagattcatcatcacatgagacagcaaatactaaaagtgtaatttgattataagagtttagataaatatatgaaatgcaagagccacagagggaatgtttatggggcacgtttgtaagcctgggatgtgaagcaaaggcagggaacctcatagtatcttatataatatacttcatttctctatctctatcacaatatccaacaagcttttcacagaattcatgcagtgcaaatccccaaaggtaacctttatccatttcatggtgagtgcgctttagaattttggcaaatcatactggtcacttatctcaactttgagatgtgtttgtccttgtagttaattgaaagaaatagggcactcttgtgagccactttagggttcactcctggcaataaagaatttacaaagagctactcaggaccagttgttaagagctctgtgtgtgtgtgtgtgtgtgtgagtgtacatgccaaagtgtgcctctctctctttgacccattatttcagacttaaaaacaagcatgttttcaaatggcactatgagctgccaatgatgtatcaccaccatatctcattattctccagtaaatgtgataataatgtcatctgttaacataaaaaaagtttgacttcacaaaagcagctggaaatggacaaccacaatatgcataaatctaactcctaccatcagctacacactgcttgacatatattgttagaagcacctcgcatttgtgggttctcttaagcaaaatacttgcattaggtctcagctggggctgtgcatcaggcggtttgagaaatattcaattctcagcagaagccagaatttgaattccctcatcttttaggaatcatttaccaggtttggagaggattcagacagctcaggtgctttcactaatgtctctgaacttctgtccctctttgtgttcatggatagtccaataaataatgttatctttgaactgatgctcataggagagaatataagaactctgagtgatatcaacattagggattcaaagaaatattagatttaagctcacactggtcaaaaggaaccaagatacaaagaactctgagctgtcatcgtccccatctctgtgagccacaaccaacagcaggacccaacgcatgtctgagatccttaaatcaaggaaaccagtgtcatgagttgaattctcctattatggatgctagcttctggccatctctggctctcctcttgacacatattagcttctagcctttgcttccacgacttttatcttttctccaacacatcgcttaccaatcctctctctgctctgttgctttggacttccccacaagaatttcaacgactctcaagtcttttcttccatccccaccactaacctgaatgcctagacccttatttttattaatttccaatagatgctgcctatgggctatattgctttagatgaacattagatatttaaagctcaagaggttcaaaatccaactcattatcttctctttctttcacctccctgctcctctccctatattactgattgcactgaacagcatggtccccaatgtagccatgcaaatgagaaacccagtggctccttgtggtacatgcatgcaagactgctgaagccagaaggatgactgattacgcctcatgggtggaggggaccactcctgggccttcgtgattgtcaggagcaagacctgagatgctccctgccttcagtgtcctctgcatctcccctttctaatgaagatccatagaatttgctacatttgagaattccaattaggaactcacatgttttatctgccctatcaattttttaaacttgctgaaaattaagttttttcaaaatctgtccttgtaaattactttttcttacagtgtcttggcatactatatcaactttgattctttgttacaacttttcttactcttttatcaccaaagtggcttttattctctttattattattattttcttttactactatattacgttgttattattttgttctctatagtatcaatttatttgatttagtttcaatttatttttattgctgacttttaaaataagtgattcggggggtgggagaacaggggagggagagcattaggacaaatacctaatgcatgtgggacttaaaacctagatgatgggttgataggtgcagcaaaccactatggcacacgtatacctgtgtaacaaacctacacattctgcacatgtatcccagaacgtaaag

SEQ ID NO: 50 - DNA, 1603 bp, Homo sapiens
aaggcactctggcacccagttttggaactgcagttttaaaagtcataaattgaatgaaaatgatagcaaaggtggaggtttttaaagagctatttataggtccctggacagcatcttttttcaattaggcagcaacctttttgccctatgccgtaacctgtgtctgcaacttcctctaattgggaaatagttaagcagattcatagagctgaatgataaaattgtactacgagatgcactgggactcaacgtgaccttatcaagtgagcaggcttggtgcatttgacacttcatgatatcagccaaagtggaactaaaaacagctcctggaagaggactatgacatcatcaggttgggagtctccagggacagcggaccctttggaaaaggactagaaagtgtgaaatctattagtcttcgatatgaaattctctgtctctgtaaaagcatttcatatttacaagacacaggcctactcctagggcagcaaaaagtggcaacaggcaagcagagggaaaagagatcatgaggcatttcagagtgcactgtcttttcatatatttctcaatgccgtatgtttggttttattttggccaagcataacaatctgctcaagaaaaaaaaatctggagaaaacaaaggtgcctttgccaatgttatgtttctttttgacaagccctgagatttctgaggggaattcacataaatgggatcaggtcattcatttacgttgtgtgcaaatatgatttaaagatacaacctttgcagagagcatgctttcctaagggtaggcacgtggaggactaagggtaaagcattcttcaagatcagttaatcaagaaaggtgctctttgcattctgaaatgcccttgttgcaaatattggttatattgattaaatttacacttaatggaaacaacctttaacttacagatgaacaaacccacaaaagcaaaaaatcaaaagccctacctatgatttcatattttctgtgtaactggattaaaggattcctgcttgcttttgggcataaatgataatggaatatttccaggtattgtttaaaatgagggcccatctacaaattcttagcaatactttggataattctaaaattcagctggacattgtctaattgttttttatatacatctttgctagaatttcaaattttaagtatgtgaatttagttaattagctgtgctgatcaattcaaaaacattactttcctaaattttagactatgaaggtcataaattcaacaaatatatctacacatacaattatagattgtttttcattataatgtcttcatcttaacagaattgtctttgtgattgtttttagaaaactgagagttttaattcataattacttgatcaaaaaattgtgggaacaatccagcattaattgtatgtgattgtttttatgtacataaggagtcttaagcttggtgccttgaagtcttttgtacttagtcccatgtttaaaattactactttatatctaaagcatttatgtttttcaattcaatttacatgatgctaattatggcaattataacaaatattaaagatttcgaaatagaaaaaaaaaaaaaaa

SEQ ID NO: 51 - DNA, 2099 bp, Homo sapiens
tttcatttgtgattcggatgatgcagctctaggtggattgactatgaaaggcgctgaatatcttcaggaaaatgggttccatgagaagtgacatcctcctcgaatcaaaagattctcaggatgatggagtgagtgatggaataggttgccaactgtagttactccactcagcacagaatggctgcggggaaatataatcagacatgcccaaagaagtctgcttagggtgaaacaaatacctttgaggtttaaatcaggaaggagagactgtttctacaggtgtcatacaaaaatcaatactgagccaaggattattggatcccatagaaccacggagacttggtagtgaaattcttccaaagcattccatccgtgcaggcagatggtgttcctaggtttggaaatataaatcccatgggaagtcagctgaagaccattttatgcatcactcatcctgttagagccctgtgctgttctgtctctctataagactggctgaaaccaccacggttgtttacaatttatgctctaactttggatcacctagttaatactctaactccgattattaccaaagacaatgttctataaaagatattgtctattagaaggatgcttctgcattattaataaaatcacagggaaaatgcaacattttggatgtcacatctgataagttggcagttaaagaacagaaacagcaataagactgcgtggccacattttcccagtgccaccaactgggatttaagctgactaacattttgaaagcccagcccatttcattcacagcaggatggcagtgggtgactgatcgtacccgccagctggctaatgtcataattaacaaagttgctactacatctgcaaagtttaatcgaaaaatttgccagtgatatgatggccttgtcacagagatcacaagggacacggagttgacttttgctcaaggtggaacgacagagctgtgtaggcaagatgagaaattgcgaacttgttcggccaaaggattatctcctgagatgtgtagaaatgaactcttgtcagagtttcaaaggaattaacgttttttggtaaaatgtgctaatgtaaagagtgagaagattagtgatacataatgaaagcaatgcattctttcacatggaaatgggaatataataaatgtcctgcaggtgattggggctgtagcaattttattgaagattaaagtttgattgacctttgttagggtgattaacccttctgaaattaaaagccagagctgaattattctgctcaatttaaatgcaaacatcgagcaggtcgtatgtcattcaaataataataagaagaaaatcttcctattttaattttcatttttgcacttctgagtggtatgctgctttagaaggaccatagctctcgcaaaagcattctggtggcagagaatatacaataacgttacagataattgggagcatataggaagagtcccaagcactactgcctgcattcgaaacatcaaaaccaccatcccaacaaaagcacggagcatgaagccaatctctgtacactgaaaatgcatgctcccaatagaaaaacaacctagggatgtcctgaaggggttaggaataaataacaatgacatctctattctagttcagtgccaaccaccgaaattgcatatcatatccatgttaaatctacatgatgtctcctggaaatgcgtgctttttggtacagttgcttatgaagcagtttctaaaagttgattatttctgatgtctggaatttcattctccatgatctctggcagtttctgaatatattcagtattttcattaagttcaaaaatgctgtaggagaagctaacgaattatttgcaatgccatttaatggtttagttttatttttctctgttaaattttctaagccttggtgaaaagttgtgtattcacatttcttcaaaaaactgtttccatttttcatatcatgttaattttgtttagttctaagtcagtgaatatttttagtcttaggtcccaccacatagtgaatgtgtctgccttttatgtatctgtgaactattaaaatgataataaaggttctcttccttccat

SEQ ID NO: 52 - DNA, 3053 bp, Mus musculus
taattcttcttcttctctaagcaccatgacaggagcacagcctttccagagggtacctacctaagttgaaggtggccttaagttatctctataaccaggtgctccagaagagggggatgagcatcattaagcagtgagcagcatcaggaagactcctgtcacttgtcagcagacttgactttcagtaaacagttggtgtctatgaaaatctaactgtcttgttaaagagagtgatttctgcatttggcatttgaaagactatggaggaggcttgagtggcattcccaccatgtttcctgagcacagaggtcagctttgcaaagacactgcttggaagtggactgcgcaggcttcttagatatgtagccatcttctgggacctgccagtcttggagagagagaagatccagaattctacaagccgcaaacacactgtattagagcaggctgagatcagatggctggggagaaatacagatggatggagttaagtatgggcgaaatcaacgtttccagatgcacagggtggactaagggtgctgttctttttgatgaagagcaaggacaagaagcatctcttgtgaatcactaggcaggtgtttgctctctggggaagtgacaggaaactcatccctgacccgaggttactgggaggaaagagcttcttttggttttgtttctctgcttggtgtacaagtcagtgccctgtctagggaagaagaacgcagatgatccttggatgtccccaagggaagaatgaccactctattacagaattaaggtcatctagagatcctgtttcctattgcacatgaatatggaatttggtaacagaataaacatgacatttggaatgttcctagagcatacttagggcaactggcaaggctgacatagcttttactgatctgtctgtttagtgagtggacaggatgccagtctggcagtttgcattggcaataaatcactactagacattttatttaaaatctggcactggctttggagaggtgagggattgtcaatttgtttttattttgaggccaggcacaatcataacacaaacaggccacctggaaactttagcacatatgtaaaagtgtggccctggtctgtggccattgcatgcttggcaggagcagggagaggtaaatgagagtaagcactgttgaccaggaagactctggcagacctgtgcagcccgaggcagccctgctggaaaccatgctggatccgaaagtgtgatataggaaggctatcatcagcataatagatgagataaaatttgttttcctgttttatcatgagattctcacagaatacattaggaacacacaagcaatgcattccatccgagagagagagagagagagagagagagagagagagagaggtcactccaacaataaagttaagtattgagctggtttgttcctgcctttgccatcctccacctcatgtcttttcttcttctcttcctctggttttctgcctttatttttgtcttggattgccccttttttaaaggataaattgtgatcaatgtctcgcagttttgagtgaaaaaatatttcacggtaggcactggaaatgttcttcggtgtagagttactgcctagcaagcatgaaatttagcttcaatcatagtgctcacacacatgcatacacatgtgcgagaatgcatacacacttatgtacacatgcatgcatacgcaaggagaagtttagactcttacagctactgcagtggcagaagttagggctccttttccactctcagcaattgtgtgattttctgaatattgtgtaaggctgaatagtatcactgtgtagcttttttagttttttcattgtgaacatatgagctactccccctgccccctaggaaaaccatatttcaagtacaccgacttactaagacaccagtcttcttgtcttcatttgcatgttatatttacaaaccttaattagtctccaccttgttactgtgcaaactcttaggatcacttagatatatctttgtgaatggcttcatttgttcatttattagaaatatataatttactcattaagctacaaatatttaaatgaccccgacttggctttcaaagagcatttcacctcttttccttgattttatatgtatagttttcataatagtatatagctaaaagtaggaaaaatatagactggtatcttcttggtaaaatcatttgaagtgatgtaatggtcaaatgcaaaggaaggcaccattttaatgctgtactgaagacactcctggtattcaggacatttgtacctaaagatacctggtattaaatactcagaaaaactgtcgaaattagatttatgacctcaaggacttttctttgtttcgataaatgtagtattagactgtttacaaaacgttctcaaaagttttcttatgaatgtaatagggagtctgttgctacaatgtcccatgactaagccatgacttagttggttgaagacattcataaaaggatacgaagaaaagcagaaaatgagagccagcctcagtgaagccacttaaaaacaccacagttctggtagtttgaacatatccaatggctgctttgagtgtcaactcagcaaatctgtgccccgaaagatcaagttggggtgtgtaggtaatgacacagatccctatatttaggatcccgggagctctgagagatacagtcacttattgggcatttgcatttctatctgactgcccacaggtaacagtggcaaacagacttccatcctggtacctgtttgcagcatttttttttttttgattcaatatacacatgaatttggattgcagttttctgatctgggtgtcttctatctattttaagggcatacatacatctccatgtgtatgtgtttacagggctctcgggtttagaatgttaagctttatgtatttaattaattcattaattaatttctcctatgctatggttgttacagagcacaaattatttgtgtgtgttaattagagtgtaattttaaattaattaaatttgtggattcaaaatatt

SEQ ID NO: 53 - DNA, 874 bp, Homo sapiens
gaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagtgattctaccagaaaggaatgaagaacagaaccttcaggaattgagtcacaatgcagacaaatatcaaatgggagattgttgcaaggaagagattgatgatagtattttctactagccattgggaagataaaaggagacagaagattgaagcctttgccagccattctttccctttttgcttccaaactcctcaactgggaaccttcatatgtgcagtatttatattggatcatactggtgattataaaagttcctaggaggctagaagagccaaccaacagagaagggaaagcagtctgttctgaacatagggacataagttcattcatgccaagtatctttccagcatgtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaa

SEQ ID NO: 54 - skipped

SEQ ID NO: 55 - DNA, 612 bp, Homo sapiens
ttcttgaaaggctggtcatgccccagtgatcaatgaagaactcagggatatcccaaaactcaggactataaggcacaatgggggagcaggtaccaggtggccagcatcctaaatgactctcagcagctgcagagaatgtaaataacaagagctgcctataaatctacctcagaagacaaagggaaaagcaaaactctgcccaggaagaccttactttacaaaccaggtgaccaaatttctaaaacatcattcccgtaatccctgatcaacagaaaggaagctctggaagcatgaatgctcaaccatatttaccagccttcctgtggtcatttgtctgagctccagctagtgaagtatgagtagaacggacatgcaccacttccagacctggcaccggcaaaccccccatggcaaccctccaaccctttcctcaacaactggaccacgctggaaaggactgaggatctagaggaggacagggctgtaatatggaaggagtttggtttctgaaggaccatgtagcaggccacctgcagggcgggaacatctttaataggtttggaatagcaagaaataaactggcctggttttaaaaaaaaaaaaaaaaaaaaa

SEQ ID NO: 56 - DNA, 1965 bp, Homo sapiens
gcaggcactaagctgggcactgggaatgtaataaaatagtcaaggtcccaccttctaagactgtccgacagggaaacgaacaagagtcaaataaggcagaagatgtgatgtaatacacctacgaaatctcagagggttgtagggtcgtgggagctcaagtgagacacttaacctggcctgagacattccagaaggcctcctgaagaactgacatctgaactgagaactgaaggaagatgagtactagtgaggctaccggacgtgaatgtggagattgtgcagggcaatgcaagaggaggctgtagaagtcaacctggctagatcacagcggggtgtatgtggggcaggagcttctttgtttgaatttgctcctgagaggatgaggcctcctagagcactggctcctggacagcaacctcctttggtgccttgtgaccagggccctgatggttcattagatggagccttcgagtcttagggagttgccgcagggtccccacagcggctcccgacggttgtgaaccagcatccatcctccacggattccggcaacccgcctggccctggacgtgtctcaactggcccgcgtgaggggccgccccggaaatgacgcgctgccccgctggccaagcggaagtggagatggcggagctgtacgtgaagccgggcaacaaggaacgcggctggaacgacccgccgcagttctcatacgggctgcagacccaggccggcggacccaggcgctcgctgcttaccaagagggtcgccgcaccccaggatggatcccccagagtccccgcatcagagacttctcctgggcctcccccaatggggcctccacctccttcaagtaaggctcccaggtccccacctgtggggagtggtcctgcctctggcgtggagcccacaagtttcccagtcgagtctgaggctgtgatggaggatgtgctgagacctttggaacaggcattggaagactgccgtggccacacaaggaagcaggtatgtgatgacatcagccgacgcctggcactgctgcaggaacagtgggctggaggaaagttgtcaatacctgtaaagaagagaatggctctactggtgcaagagctttcaagccaccggtgggacgcagcagatgacatccaccgctccctcatggttgaccatgtgactgaggtcagtcagtggatggtaggagttaaaagattaattgcagaaaagaggagtctgttttcagaggaggcagccaatgaagagaaatctgcagccacagctgagaagaaccataccataccaggcttccagcaggcttcataatcctcggttccccagactcaccggacaccatctcctatgccttggagaccttctgtcacttggctcccttcttaccaccaccaagactgtcccactgggcctgacccacctatgagggaagaagtcccacctgggccagagggagttcatgtgttactcataacatgcatttcaataaaaacatctctgcggtgggccttgggtaggagagatgaacccttccggtgccaagctagtcccctctggtgtcctcgactgccctgctccctgtgtatctgcaaacctctgttctcccttctccattcatcaggaagggatctgctgggtaaagtcagactactgcctaccactttttcccaaagtagactgaaagcacatcctgtgctgggcggagcagctgtgtttggatggtttcatttcagcatgagaacagactcaaatagaacggggagacttttccctcaacaaaaggaaagacagtcctatttgcactgtatcacccttgagatactactgttacagagattagaaccacattgagtggggttttctgtgtaaatcgaaggagaaaaagaccagattactgagattggggattgtaactctgacttgccaaacaaactgctgcctcaaaaaaaaaaaaaaaaa

SEQ ID NO: 57 - DNA, 3892 bp, Homo sapiens
cataggcagtctcctggtgctccacttctcttctcagtctgttgtaatcttctttaacacttcccagctttttgacattcctggaactcaacaccaacagcttgctgaggagtccctccagcccttctctctctgatgttaatgatctaatctcctcggtgaggtctttagccgtccagaaatggtttcctacagcacgttgtgggagagaagaagggaaaacaagctttacagcatccacacacatggaagatctagcagcagctaatgtacattcacagcatgggcaaagaaactgcactttgagattatgtacaatttccttagcagtcctctggggaaagaacctggaaaaatattgctctccttaaactggaaaaatcaccgtcttttttatcaccttattcttgttatgtccattttaggagttccattggtgaagccatctcccgtaaagtatgatgacccaaaaatgtcccagtggaatccagagaaaccacaatgtgtcactccattccaataatatacaaatgtcaaagagatgacatattatagcagtgtggaaggggactgggccatataatcagagttgacctaaattaaattcctcccctgttactcaaactgtgtgacctggagcaagaaaattagcacatctggggcaaatttcttataaaatataattgcaataacacctgactcataggtagttacaagaataaacaagaaattctgtaaagcactgagaaaaatatatgataaattaaatgtagcaagattgcaggatacaaggtcaatgtacaaacatcaatcttatgtctaaataacaaaaaactagaagatgattttttaaaaaatacaatttacaaaatattttaaatctcataatactgagggatactttctttaaatatgtgcaagagctctacagtgaaaactatttttcaaaaactgctgagacaaattaaagacaaataatttaaaagatacactgtatacatacactggaagttcaatattggtaagatttcaattttccccacattgattcattgatttaatataattccaatcaaaatgttatgaggttcttttgtagaaatttatgtgcttattctaaaacgtctaagagtgagctgggcatggtggctcacacctgtaatcccagcattttgggaggccgaggtggtgggtcccttgaggtcaggtgttcaagaccagcctggccaacatggcgaaaccctatctctactaaaaatataaaaattaatctggcacagtggtaagcacctgtaatcccagctactcaagaggctgaggcaggagaatcacttaaacccaggaggtgtaggttgcagcgagctgagatcctgccactgcactccagcttgagcaacagagtgagacttcatatctaaacaaataaaatctagaagaatgagcccatgagtttgaggctgtagtgcactatgattgcacttttgaacaggcactacactcttgtctgggcaacatagcaagtccccacctcaaagaaggagagggagaaagaagaagaaggaggaggaggaggtgaaagagggagggagggaaggaaggagaagacgaagaagaatgaagaagaataggaagaaagaagaagaaggaagaggaggaggaggatgaccaaagcaatccttaaaaagtgagtcttggtttcaagactaatgctaaagccactataaatcaaggtaatatggcattgaatatacatagacaaacagatcgatggaatagaataaacagtccaggagtggattaacacatatacagccaaccaaagtgccaaagcaagtcaatgaggaaaagaaagtattttcaataaatggtgctggaacaactagctatctacatggaaaaaatattaaccttgattcatacctcaaaccacacaaaaatttaattaaaggtggatcacaggcctacatgtaaaagttaaaactataaagcttctacaaaaaaaaaatgaatatttgattgactttggagtaggcaagaacttcagataagatacagaaaacactattttaaaaaggataaatgggctttatcaaaattaaaaacttctcatcaaaagacacaactaaaaaatgagacgacaagtcacagacttggagaaaatcattgcattatgtttaactgacaaggaattgaatactacaacttgacaattaaaacacaaatggtgccattgaaaaatggtcaaatgacttaacaggcattttacaaagtagacgcacaaatggctaataagcatatgaaaaaacatttgacatcattaatcattaagaaaagaaaaattaaaaccataaatattccactacaagcccactcaaatgtttcaaattaactcaactaaaaatgtcaacattcacaagggtatggagcaactggaactctcacgcatgtaaaatggtcccttcaagaaaagttctgccagtttctcataaagttcaatgtatacctaccctttaatccaacaattctacttccaggcatttacacaaaagaaatgaaaacatgtcatcaaaaatatttgcactcaaataaatggtcacagtgtcttatgcctgagagccagccccatactggaagcaacctaaatatccatcagcaggaagatgcaaaaataatactatagctatgcaatgaaagactactcagcaataaaaagaaacaaactcgtcatacatgcagcaacatgtatgtgtctttttctttctttcttttttttttttttgagacagagttttgttcttgttgcccaggctggagtgcagtggtacgatctcagctcactgcaacctccaccttccagtttgaaactattctcctgcctcagcctcccaagtagctaggattacaagtgcccaccaccacgcccagttaatttttgtattttttagtagagccggggtttcaccatgttggccagactgttctcaaactcctgacctcgtgatccacccacctcagccttccaaagtgctgggattacaggcgtgagccaccgcgcccagccaacatgtacatgtctttagaaaagatgcaaaagagtagtgccacatgattccattaagttctagaacagccaaaattaatccatggtagaagatatcagaacagaggagggacgatgatgactgggacaagatagggtgttgtttcttgagtgatgagactgttctatctcttggtagggctgttcgtaacacaggtgtcaaaattcaagaactgtaaacacttaagacctgtgcattccactgaatataaaccatacctcaattaaaaagaggaaaaattaagaaatttttaagcatgaacattgaacaataaataaatatataacattaatgagtgtcccataaattagttagtgttaattagaaaaccccactgtgttttctcagaatttatagtaaccataatcacaataatagctacaaactttctcacctttaaatgtcatcacaactttaggaaacaggttatatcttatattattattattattattattattattattattattattattttacattttaacatctctgaaacagggatgtgtcctacaatcaccatcagccaggaagtggtcaggatgcagtggttataactggattattttccctggcctggctgaccatctgcaaccccctggtgtttcaatgtacaaactattttaggaccatctgcgtactggctgttgcctgaaaatcttgtgttgatgtggatttgtaagactgggaaagcaccagcattcaaaacttgaagaaaggtgttagcagtttggcagacaatcctacagaaaactctttattcttgggggagaaaaagttgcctccca

SEQ ID NO: 58 - DNA, 10156 bp, Homo sapiens
agacgggttgataggtgcagtacaccaccatggcactttatacctgtataacaaaccagcacgttctgcacatgtatcccacaaaagtaaaaaataaaataaaatacatctacatgttgaataattttaaaaaacaaagacattaaaaaaagaaaattaaaaaaatattgttcacatatcaatctccattcctccacttctcctcactaattactgacaatatcccttcacctgtgtgggtagaagaaaaattctagcagttcaaatccttggcctaaaccatcattgctaaaatattcactttttaacttccaagaagttagttaaatcatattctcactcaaaatacaagtaatttaaatgagtttttatcagtgagtttcttctggaggctttgtttctttcattactctcagcagcatgtaagaagcaatagggtgatactaaaatggttttgtctaacctgaacgctgtgtgtctggatcttcattcactctgtggaatctgtattctatggaattttaagtccttttggcaggaaattgtaaagtgaacagaaacatgggtcccatgagacttcttgtgccaaaacactatgcattatcctggtacctttaagtccaaagagaattgtttaacttcttcattcttaatattatgttgataacaataacaaataaaggattctaagctactcacacatgacatataaattaaagagtgttttttgtcacccaaagtcaaaacacaaattaggatatttactctcttgctttccgagggtgatttctattgctgtagacaatttttagagaaaataaaagcttttaattttaagtgacctgatagtctgatgttagttatctctgttgagcattttctgttgaagataggctcactttatctttaggctatgaggtcttagtgtgatggatttgtctaaatgtaaaacaaaacaaaacaaaactatgctctctaagtaaccactaaattctgtttataaatagaaggctaaaaaatgaagggtgatatgctacttggaattcaattaaaaggaactaaaaaataaattataatattatgcagaagcatcctcagatctatttaagtatttcagctttatagtcctaaggaaattcaaaagcagtgacagtaatgggtgaccattcaatgtaaccttgattggacaactttgactatacaactaacttcagattaatttttagtgggagtttttaaattgctctttgtaaggtggacagtgatgtgagtggtccttttagaagttttttttttcctgatctcaaccactagtatattttattttcattagcatatccaggggatacagtagtgccttcttatctgcagattctctttccacaatttcagttacttgtggccaaccatggctaaaaatattaaatgaaaaattacaacaataaacaattcatcagttttacattgtgtgccttttgagtaacatgctgaaatcatgtgctatcccactctatgccacaaggaatgtaaaatgtccctttgtccagggtattcacactatataaactagctgcccattagccattaacattgtttgatcctgacatctaaccaacaacatcatcatggcttgaagatccaggatcacctaaagctatgtcgcaatgcctgcatcactcacctcacttcatcttatcatacaggcattttgtcatctcatatcatcacaagaaggttgaggactactgtaaaatggaaagcatatccattaacctcacagagatcagtaccctggcaaaggttgtttgcatactggaggacaaatattttatcgtaaagaacttagaaaactttcaaaaatgttttggaaacaatttaatgaaccagaattttttaagcatctaatgattttctggcatgcacaaaggtatgcacattaggaaagcaatacagaataatttttttaagagatggggtcttgctctgtcacccaaggatagattgcagtggcatattcatagcttattgcggcctcaaactcctgggctcaagtgatcctcctgcctcaacctccaaagtgttgggattacaggtgtgaggccatgcctggcctggaataatgttttgtaatggtttatagtatggaaatcagagttggaaataatgactttaattctttggtcctgcatattactggctctggatgtccaggcaaccacttagttccttaaagcttcagttttcatacctgcaaaatgggagattaaaatacccatctcatagggataaatgtgtgtagcacagtacctggtgcatagtaggtattcatgaaatgtggctcccgctataagcaatgaaaaccagcaccaccttaacattgacccttttaggatacaacgttccaaggaaaagtttaattttgcactggttaaaggaatttcaaatcattaccaggggaaaagtgtaataaactgccaagataactcaataatattgagttattctcaatagatacacgaaataatattctacttggaaattcaattaaataagctccacaaatgtttattgaatgcccactattcactaggtattgcattgggttcaggagatttaaacattagttaagacagggatcttgtttccatggggcttacaatctcatgagggagacagattcacaaacacaaaaatcccttaaaggagtttcaaagaaggggaggcaacagcttaacctgggaaggtcaggaaaagctttgaagaatggataatactgaaatataagctaggtttagttgtagagtgtaacaggttttctttatcatcaatctctgtcaactgcctcatcctctgccacaaccccaagatatttcctagagctactttcaaattttcatgtgcttttggggagcagaaaagacaatatgcttattgattatcatatttatagaagaaacaacaagatcattttctttactgttactcattgtctaccaatctattatggtaatgaatgagaagaaaaaataaggaagatgtttagaggttattttccttaaagggagattccacatcctgtgcctgccttggaagccttgaagaaaagactatgcttacccacaaacatctcttggcaccactgtcaggtttgagtggaccacagcaacaactcatgagatcatttatatttgtatattctttgtgtataaacttggaatttatctaaaaatagcacattagaaggtgcaaaaccatttaatttgccaagtacttgtcataaccttaatgaagcagttcacttggttgggaaccaataataatatagacaggtagaaaacacagtgatcaggtgaggacatgaagaatgtttgacagaatgtatttatttctgtttatcttcacatgcaaccttgtcaaacacggtcaaattttcaatgcaaaagattaagcatgctaatgcataattctgagatacctattttaaactgcaggttgcatgaaattaatctttttaaactactcatcttcaggagttctcacccttctatcaaagtagtatataagctcagattctcattcagattctaattatatcaaacaatcacaagaatgctactaaactgaagagattctctctctgttaagggagaagtgttgatgtggacttgaaactatacagtcacttttccttttccatatattttcagttatacaatgttaaattcatactttaggttctgatatgaaagagatacagagcacctttaaaaagacactgaaaagcaccatctgttcatgctcaaatcttgaagaaaaaatttttaacttgttaatcataaattgctctacaaatagtatactggaaacatccggatgtgaggttataattaaaaatgaaagcaaaacagcttccctgaaaagaaagaaaactcttaattcaaacctaccagatagctgatttatgaaagtgaaaatgctggcatgtatagatattgggaagtcttgggatctggattttatcactgaccatctggttatagtcagagtgaaattttaaaatagcaaaatattcattaaaagcctaaagaagctcataccaacttgacatgccacaattagttatatatcccatgtatccccttctgatatcaattatgtcagttccattggtgacatccccgttaatatttgatgacacataaacgtccagccactttaattaggatcaagagaatgggcatcaaatgagtatttttccgtcaagctgggaataataatactttatcaagaccaccttttgatccctacatgtgggaaaactgaggctcagacagttaaattacttgcccatagtcacatttctagagattgggagaggaggaaatcaaatctaggtctatctgcctccataccgtttcttcacaagaagagactatcgattccctgagctgcataatgggatttgtttgttcctttcagtttcctcaagcatgaccactacatctgctgtaactagtatccacaattacccagctgcatttaactaatttaaagctcctcataccaattcattacctcaaaaactatttgagagttgaagaagtttctcagaaattaatgttgtaataaacaacaacaacaccaatactgggccctctcattgattcatattttcttatttatcccttctccatagaacactgcaaattgataaccaaacagaaatttctctttgtgatagtttattttacatgtcaacttggctgggctaagagatgcccagatagctgataaaacattgtttctgaatgtgtctggagggtgtttcggagtaaattagcatttgaatgagtagaatgagtgaaaaagatcgactctcaccaatgtggacaggtattatccaatcgattcagggtctcaataaaacaaaaaggcaaaggaagggtgaatttttgctctcccttcttgagctgggctatctatcttttcctgccctcagacatcggacctgcttgttcttggtcctttggactctaggacttaaaacagcaccattcctacttttcagttcttaggcttttggagtgaaattgaatgataccattttccaacttgcagacagcaagtgatggaatttcttggcctccataatcatgtgagccaattctcataataaatctctttctctcctttttatatatctcctattggctatttctctggaaaaccctaatatactcttgttcatatattttgttactttttaactcatttgcatctcaggcaaaaaaaaatcttttcttattagcttctatcctccaatttctttcccttgtctccaagaaagtcactaccaccctttttcttccttcattctttccaagatgtcaacccatgtgggctggtctgctatcatctaaatcattctgctattactgtggtcagtgggaggcagaagtgataagcagcaaatatacatcatctagaacttcagttctgacccactggcaaagcgtcttcaccacaactgaaaaggttctgaggtagatctgggtttattatgaaagattgacacaattgaatattaatgtcttccactgaagaagaaaggtaatgatacctatgtcttatgttttctatccttggcataaggcctcaataatctcaattcaaatccaaaagttttcaggaggaaacctctggacacattaaaatctcttatattaaacttacagatatttatttagaccttttcatggagtctaccatggcttatcactgacaaacggacaaagaaatataaaggcacgatcctcatctctatagttacttaaaagggcaagacaaactctacagcattatggattgttaagcgctaggtaatagcaaatagaataaacagtataagaatgcattagatgataacactactgagggctgtaaaaatctctgaaggcttcaggtgagggggagatttaaactgggccttaactgatttgcaaaactaaacaagaagacagatatgggtgttccaagatagagtgggaagctttagcggtggtatttggggaaaattaattggtcagtattcctacggcatccattctacagacagcaacagtatagacaaggaactgtctgaagggacaaaagtgagatgttcagcagggtaaataggggatggtgtgataatgataatttctttgattatagctatctgctaagccctgtgctaatttaattttttaaattaaattaaaactgcataattcagagataattattatctctttttcttatcagaaaattataaacagttgaggtcttccaaggcaaagcccttgttgttacccatcatgctgagggttagttcaggtgcttgcgcaatggcatgtacatctatctcctttgttttgatacatccatccttgactcaggaatagacctagagacctacaaaagtctcgagtttgccgagacacatggcagatgagggaacacaccactgtggttccctcaggaaacagattctaatctggctttacattttccattgtaatcttgagatgcctcatagtcaaataatagttcctcagtgaaatatatggatagtcatatgatagtagaatgaataaagaccttatatagctacttggcatttcaggccaagttttattgacagactagtttgctacaaacttatgaacccatttttattttctagatagcaaaatgttaacaattagggacctgattgaagggtataaaggattgactgaattattgttgcagtttttatctaagcttattttttagtactttttggatattggaaatgtggctaagagactgtggacacttaagcgttcaataactgttagttcccttctcttgtgctgtagaaaaagtacaaaaggtccaagttacctctcagatatcaggcagatgattaattgtactgtgaagcggtcaagtcctccagaatactgcattttgggaacactgattagtcatattcttataagaattgggagctgccatttttaacagtttgaataagaaagttgcattgccaattctgtacctatctgatatgttctctccccggaggagaagaaacaggccttattcatctccccctccccaaccctaaacattcttcccaagtcctgaatatgcctgaaaagacatgtcattatggtttttcctgtggagtctagagttcccccacctgcaccctactgaagtcattcataggaaaaggcaatgacagccagatcttgacagatcacccctagcacagtttcactgtgatcccacaggggctttactgaatatcagtcccagagctgtctgtcttttccatttgggctgctgcagactgagctgagtaggtcagggatatgttttacaggcattacgcaggccagtcttcagaggccagtgtgcatggtgggtccagccatcctcagacatactctgcacatgtcatgctgggggacagagcagcgtgtgtgctgtctggatgattcctcttggaatgttggttgcctagcaacaagatcatgctttgctcttaagtccaattctcaggactttggcttagttacttctgatccttagactttttcttaccatccctcacccgggttcccagaaagtcaggggcttcaaattccaaataatgtagttattttagctacgtggtggcagtctatatgttagatttccctttggcatcctacctgtactttatacacaccaacatttctctaacagttttaaatatgctacattttaaaagactacacagttggctttccttttttaacacagacacatgtacagcatatgtatgtattagaaaaagaatggaaggataaccacaatataaaataacagcagctttccctttatggtaggaatattagatttttaaattatcttcaataaatgtgttaattttgtaataaggataaatattagcataatatatattgggattatatgctattaactgacatttaaaaatatatacaaagtaatggtaaaggaagaaatactgtcacacataagtacaccacaatttcaaccctatatatgtggaaaaatatgacaggaaattaatgaatgaagagggtttcatcaggataacagtaattttttcttaaattcttgaattttaatttaaaaataacaaaccttaaaaatatatagtattggcatatttacagccatatgttttaaaaggcagaggaaatcatctttatcatggcaacaagggtcatttgggcagattcccatagtaaaagattaaaatatattttggacccagagtttgttccaatcattccacttcttcattcactcaaaaagccatgtttaagcatctgctttgtgccagatatgtgaccagccctgtgaatacagacctaaagcagagcatctctgccctcaaagaatctatattaaaagtcagatgagggataaaaaaataggatgcaccatttattataatacttctcaaaccatgttttgtgggtgttttcaagtgaattttagatttctctacaagtcttaattttatatttatatggtaatctatttaattaagcaagtttttcagaatcatttaaatggcaccttataactgagtgctaacacaggacttcaaggtctacagttatacttgggaatataattgcatagtactgagtattatttcatagtcttggctaatgagaaagggacctaaatataaatgatatgttgtgacacatgaaaggcaactgatgtcataggatatttgccaataatttgaatagtgacaaatggccagataattgagtcatattgggatgtgcaggatggcatggtcatgccaaactcaaaagctgttaagactatattcatgctgtaatcagagatcttgtttcagcaaaatgtcattctttatattaaataaccattgttaatgttaatttcattccactagaatgcagctctatggcaaaaaaaaggctttatctgttttatctgctgctatacccctaggacctggctcataactgcctattaaacatttgctggatggattaataaataaattgagtatttttatttatttatatatgttttctaaatttatgcttatagtttaataaaagttatgcctgttttgtgttgacatgtgtttaaatatattttataataaaaataacactggtggacttaagagaatttttctcctttaaagaagaaatatttaatattaattaagggtgctgttggccctttaaaaaccatagggttaaacctaactcttcctttttctgtgatatccgttttctggctcttctcttctacttttgcttcccaccaattcacttttcaaaattcccacatgccctttctccctcttacccttttacttcctatacttgccaaccctagcaacttcctcactctatcatcatacactaaaacagaggaagagaagagaagaaaaaacaaaccagagaataaggcaggttttccacagccccccaagaccgtcaaagtgaaggtaagagactcagaagttaccagctaagggttcaaatgctaatttcaccatttatatactgcccatcagaaccgagtagacattaaccaattttgacggcgtactcttcttgtcaataaaaattttaagcgcttagcatattacttgcaatagctctgggctggagcatccgtttcctctgttcacatactttagaaggtctcactccgatctttctctgataagaactcctcctcatcaggtgaggagcttgtaggatcaaggggatgtgcccatctggtgcctaagcaccacctcatcaagagttcgaccctgcatcctgcccaaattgtcctgtttctagaccctagatatgtgcctaattcattttttaatggtggaccatctctgcgggtgtgtgtactcctaagtatcacaatgggtttcaaatggtgtggcttaaaagcatgtgctaaagtgtcaatagctctaaatgtgagtcatgagacagtgcagaagaaatcttcatggggagggaagaaaacgaggtggttcttagcccaggagctcaggtcccttcttcctatgctacctccttatggctaggaattc

SEQ ID NO: 59 - DNA, 2970 bp, Homo sapiens
gggacctttagagagttagcaataaggctggagaaggaaaagccggcgcgcccgcggcccgcgcgatttcccgccgagcccgcgtccccggcggcgggcgggctccgggggcgcccgggccgcggcggcggcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgaaattaggtccagagttgaagttcccctaattgcttcctctaccatctgggagataaaattgttaccaaagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctatgattgacattttctgctcggcagagttcagggactggaattgcaagagtattttcatgcgtgttgaagatgaactggaaatccctccggcacctcaatctcaacatttccaaaactgaactcatcacccctcttcccccaccaccaaaactgctcctcctcctgtattcctgacctccgccatccaccccgttgctcaagccggaaactcggcagcccttccaaactcttccctctctcactccccacatcccatcgtctcggccttcacaatctgtcagttctaacctcctaagcaactaggccttcagtaaatgtgattcacctcttctttccctccttttcccaaagcatccctcttagtctaggtccttgttgtttcttgcctgaactcctgccatagtcttaactggtctccttgcttcctgtcttatcctccaccgtctttcttttatactgacacaagaatggtctttctgaattgcacatgtgagcatgtcacttccctgcttaaatttctccagtggattcccagggacttcaggatcaagtcctagttgttcagcatggcatccaagactctttatgatctggcccttgcttacctctcagccttagctctcccaactcttgcacagtcactgctcttcagccatagtggatcactcaccattcccagatgtaccaggctctcgcacacctctgcacctttgcacgtgctgtttgctgtgcgtggaatgcccttcactgtcaccaccctgctcatccactctactaatgcctcttcattcttttatactcagctttctttaaagttcttctaagctgagttaggtgtctgtcctttatgatcccgcagtattccatgaatacgtatattctcacatttattgtactgtattataattgttgaaaacttgtctgtcccatttagaatgtgagctccttgagagcagaacggtgtcttcattatctctgtatccccaaggctttgcacagtgccttgctcatagtaggttttcaataaatgattattaaataaataaaaaaaaaaaaaaaaaaaaaaaaaaaaaaaaaaaaaaaaaaaaaaaaaaaaaaaaaaaaaaaaaaaaaaaaa

SEQ ID NO: 60 - skipped

SEQ ID NO: 61 - DNA, 1472 bp, Homo sapiens
atccttcacctgttgcctggctagagttgtctggctccactttgagctcttgcagaaccagccctttttcgtgtggtccaggaaagtccatgcctggcaccacctcctcctctagtgactccacgtagaagagagtcctggctggctgctgagtgccctgcccaggagccccttgctgcagcctcgtggcaactggaagcagggtgccattcagcggattgaaggaagaggaggaagaggacggggaggacgatgaagaggaagaggaggaaggcttcttccagaaagtgctcacaccgcttctctcttggcttttgagcaggcgactctggctgggtccccagtgctcaaagctgccactgccgtcctgttgcaggcagcctccccccgccgggccgccggtggaaggagacgggtggctgaagagtttccagcggagtcgcagaatgtgcttcacatcgaagtcttttcgcccagagcctgacatgctttacgcacagaaggcaaaaggctggcagctcacgcaggattctggaggctgggaagttcaagaccaatgcacgagaatttggtctaaagagaatcttcttgctctgaacacacatagtagaaggcagaagggcaagagagagaacaaagtctgtgtctccacatggcagaagagcagaggagacagaacctactcctctatggcaaccaccccatcaatgacaaaaatcctagaaggatgtatgtataggaagttgaagtgttgagaagagaatggctcagagtcaagcgggaacaagattcaaacttcagagagagagggaagaaaaacatttaaatatatctggcataatccaagactatttacgacaagtgttctgtgtttctaataataaaacagacttcacctcggagtacctgcagaactgggaccccaatgaccagggagaatgaagaacaacttgttgaagattgccttttctgactcccagcttccacggagagattaactctgttggctgaagccctattcccaattccttggctagaccctgggtccttcatgttagaaaacctggctttactactactactactactactactactactactgctgctgctgctgctgctgctgctgctgctgctgctgctgctgcattttttaaaaatatattatcttattttactatttgatgttataattgttatatatttttccacacttcctcatactgcttatctcttacttaagaatttatgaataaagaattgatttttcaatacatccttccaaaaattatctgatgttgagttagttgctctctcttgtgcattctcagtcctcacaagcctttctcaaacacaatgtttatcaaagaaaattgtagcaaccaatatacttagtggaatttctcacagagtttgagtgtaggaaacagtattcactgtatattagtcattttgctcccaatagaaggtgc

SEQ ID NO: 62 - DNA, 6166 bp, Homo sapiens; identical to SEQ ID NO: 17

SEQ ID NO: 63 - DNA, 3628 bp, Homo sapiens
tcaaagacacaaataaatgaaaaaacattatatatgtactcatggactagaagatttaataactttaagatgttaggctgggcacagtggctcatgcctgtaatcccagcactttgggaggctgaggtgggtggatcacatgaggttgggagtccaagaccagcctgatcaacatggagaaaccctgtctctactaaaaatacaaaaattggccggacatggtagcacatgcctataatcccagctacttgggaggctgaggcaggagaattgcttgaacccgggaggtggaggttgcagtgagccaattttgtgccattgcactccagcctgggcaacaagagtgaaactccgtctcaaaaaaaaaagatgtcaaaactcttaaaaatgtcaacatcagtaaccagtagagaaatgcaagtcaaaaccacaattacgtattacctcacatccattaagatggctactaacggctgggtgcggtggctcatgcctgtaatcccagcactttgagaggctaaggtgggtggatcaagaggtcaagagatcaagaccatcctggccaacatggtgaaaccccatctctactaaaaatacaaaaattagctgggcatggtagcgtgtgcctgtagtcccagctactcgggaggctgaggcaggagaatcacttgaacctgggaggcggaggttgcagtgggccaagatcccgccactgcactccagcctggagacacagtgagactccgtctcaaaaaaaataaataaataaaaagatggctacttacaaaaaacctcaggaaataagtgttgatgagggtgtacagaaattgtaactcttgttaaaaatataattaccatatgacctggcaattatacttctgggtatataaccaaaagaaagggtcttgaagagctatttgtacacccatgttcatagcagtactattcactacagccaagaggtggaagcaacccaagtgtcccttgaccgatgaatggatgaacaaaatgtggtatatatccatacaatggaatattatttagccttaaaaaggaaagtagttctgatgcacactacaatgtggatgaacctcaaagacattatggtaagtgaaaaaagacaaatgtcataggattccacttatatgagctatctatgaatagtcaaattcatagaaacacaaagtagaatggtggttgcctacgtctgagttgaggggaaaatagggagttgttgcttaattggtataaaggtttgcaagatgaaaatgttccggagactggctgcacaataatgtgaattgtgacagtactgaattacatacttaaaaatgattaagatagtaaattttatattgtgaatatctgaccacaatttttaaaatgctaataaaaaccaaacaaaaccaaaaataaaaataaataaaatggaggagtgtaggagggaggtgggtgtaattataaaaattgttggcggggtgcggtggctcacacctgtaatcccaacactttgggaggctgaggcgggtggatcatgaggtcaggagattgagaccatcctgactaacacggtgaaaccccgtctctattaaaaatacaaaaaaaaaaaattgccaggcatggtggtggcaggcgcctgtagtcccagctacttgggaggctgaggcaggagaatggcatgaacctgggaggcggagcttgcagtgagccgagatcgcgcctgttccagcctgggcaacagagcgagactctgtctcaaaaaaataaaaataaaaaatatataaaaattgttggaactgttcagcatctcgactgcagtggtagatacatgaacctgcacaggtgacaaaattgtatagaactaaacatacacacgcacaaataagtacaaacaaaactggggaaataaattttaaaaaataggtagcatatgtcaatgtcaactatagttttgcaaaatgttaacattgggagaaactggactaagtccagaagtaccttctcagtatttcatacaattcggtgtgaatctataatcatctcgataagaaataaacacacacacacacacacacacacacaaggcctgtttttaaaaaacgatatatatgtgtgtgtactaatatataaggcagtagaggtaaatatccaaacaccagaggttaggtcataataaaaatgattcttttcatgtgcaggtgacaatatgcacactctataacaagcaatccctctggagaaactcatcagccaaacacactaatgtgacctatatgcaagtaactcctatggctgactgccttctagacacctcaccctgatcttctctataacggtctgatctttccaagaaacctgctctacccactgtctgccccaacacagttaaggccagaccttgagaggagaggccaacaatccttgcacaatggccaccccgcccccacgacttttctgacctcatctcctactaacccccaccatcgctggtcttcctcttttcttggactgtaccaggtgcgctcctatcttgggccttgtactgactcttccttgcctccttcaggtctttgctcaatgtcaccctcacattgaggcctactctaacaactttaatttaaaggattatttccccaatgtggcacaacaaatccccttagtcctgatctatttatttcctcgggaattccttacatattaatttcctttattgtatgcctgtctactctgcccactagaatgtaaactccagtaagtagatcagctcttttgtctgttttattcactaattcatcctcaggacccagagctgtggcttggcacataacaggcacaacaataaaaacttgttgctgttgaatggctggagaaagctcatgacagaagcactacattcaaacaccttcagtatcactggtgtaacaatctttggaaggcaggctcctgatctactgctgtggggactcagatttcgccaactgcctgcaggtgggaagcacacccttggctggttcacagccatctgctgctgttatctctaccactttcgaccacaaaaacttatccccatcttctttagtaagcatgacacaatgacatctcataggtgtcagatgcctaagagattgaaaacatagcacaggaaggaagctgttgcaccatacaaccattgtgtgtgtgtgtgtgtgtgtgtgtgtgtgcacgcgccacaaactaaagtggaaaagtgtcacaggtatatcatttaggagaccttaatcacttctcctgaagcatctgccaacatataatcaacaaagttttgagattgggcgcagtggctcactcctgtaatcccagcactttgggaggccaaggcaggcagatcacttgctctgaggaattcgagaccactttaggcaacatggtgaaccccatctctacaaattaaaacaaaaaacaaaattacccagtagtggtggtgcaagcctagatggagtcttgctctgtcacccaggctggaccgcagtgatgcgaccttcagctcactggcaacctcccactctgggtttcaagcaattctccttgcctcagcctcccgagttgctgggactacaggtacatgccaccacacctggctaatttttgt

SEQ ID NO: 64 - DNA, 3628 bp, Homo sapiens; identical to SEQ ID NO: 63

SEQ ID NO: 65 - DNA, 3480 bp, Homo sapiens
tgcttagagtcaggagaataaacggtcccatatagagataggtttatgaagcggagtctgaaggatgagcttcatcagcaatcctcagaatgtcagttctactagctaaggatgcaggtaagtatgttggacaccaagagaacaggaaggaagtgttttgaacactggaggtgggtcatgaggaagcttatacatattcacattgtgaatcaatttcaaggacagatgaacaaagactgggcgttaccaatagagcagggttttgttttgtttttcccctaaggcaaaaggcagaaatgagtgggtacaccatgattaagttgcattctgtagagataggatcatttaagtcaagtcagcaacaaaaattagagacattgaagatgatggggtagaaaaggggtatcaaataggttagaaagatggcttgaaaggaaatgagggaaatttcagtgagtttgaggaatggcagactgggtatgtgacaaatgagtgggtaaataaggaaatctcagattgagaatcctggcagatctttcaatgggttagactgcaggaatattgattttaaagccagactgaagcaaattctagtgataaaggaaggggaaagggtggctgaatcaaatgttctaccaatactgctttttttagtatttgagttaaaattcagattaaatgcttggcttagaagaatgcaaagcttcactgagcctaataatatggatcccagtgggtgagtggaggtgagttaaagtaaaaaactctgaggcaaatcttacttaactgaagttgtgtttttagtacagaatgccaagttaatatggttaatactgaacaaaaaataatggaagggcaactacagtagcttaagatggcactttaaggaagtgtaggcagaaagtcaagaaattaaaataattatgaatcattatatggcaggcaatatttccagtgaaaatcagagaaaataaactcacatacatgtactgttacagctgatcttagtatgaatattttctattaaagactgttttaaaataagttattaatatttgttgaaatggttccagataacaagaaatatgatgcaataaaacctgataaataaaagcaatataaagattagaatggttttgaataggtagtggaatagaaagttaagttggtagttgcattaaaaaggtcaaacatggggaataattggtagaatgttgtgtatataatatatattgttacgggtgcaataaatattcaggggaaacagagctgctgaaagagaatgaatgcttagaaggaatgttgccttaaaggcttttctaaaactttttaggtaaaggacaaattctgggaggacgaaagataataagtaggactagttacatagagacttaggatgtccatagtctttcaagaaattgcccaacctttgcgagaaggtgttatggtaatatattgatgttgggttaaagcaaattttttcagatagggtagatttttatacatttataaagtaaaggggagtaggaaagattaaagatagatcaaagaaaggaataattgatggaacaactttctggaagagattagagggtatgtgtcttttgaactctggaagacttgattttagagaggataaaggaagaaagtggataattctagaattaaacaccaaaaggttctatgtgtctggcaccatgtgaagcaacttacctattatttcatttcatttcatttcatttcatttcatcctataacagtcctaagagatcaaataatttgtccacgattacacagtcagtatgtagcagggccagcattcaaatcctcatctgtctatcaaacccatattcccttctattatgctatactgttttcaagttgaaggaaatcaaaccaagaatttctgttttttcactgcgattataaggaaaaatattatttttctgaaatgagacatattgatgtttaagaccttgaggtgacaggtaaaatttggaatatctgtgatgggaaaatgcaaaaaggaaggaatgggtgaaagatacctattaccatctatgccctggtatttcacttcttccattgcacagcatagactttagattggccatggattaaaaatttgagaattctgacaaaaaactaaatagaaaggagtttgttttttaagtaggtatatgatgggtcaaatataaacttactactaacaaaactttaaacaattccctaaatgccaaacttttataaacaaaaatcaaacaaaccatcaagcaaaagagtccatagccagcagaccaaatgttgaaatctctgggctaatttgtaagatctatgttttaaaactccttagtgaagaggggcaagaaaacctctcctctttttcctctcttggtggaaatgttttgttgttgttgttggttttttcctatactatatgtaatttctatattgttgttttgtgtattttggtattataaaattatacttcttagattccgttaagaatactttctggggtgtgagccacctgagttattagttagcaaaatgaacctggggaagtgggaagagctggtattctcaattggcaagggattgattcttcaatgggttcagcatttcacttccctctgaaattaagtggcaaagtaatagcatcccttaaaaaacaggacattggtgagaggtagaatagcaggaggaattttgaaacatggagggatggctactggaaaagaacagatgaagtgcagagtctctccagacaatggtagaaaccacaggactacattaagattgggcccaaatactagtttagaaaaaggtaaataaaactagctttacttaagagtacagccagcttaattactggctagtggacatatttcagacaaatctaactggagagaaaaacagaccaggagagaaagcgaagttacaaggaaatggaactagagaaacctcacaaagggataaaggaggtaattaaaggttaaagccagatagcctcgagctcaaaggagaaatattggaggccagataggaaagtgccttcctactcagggggttatggatccagggtggctaaagaatagaagtagagttccacccagggccagagggaacaatctgggattcagacacagcagtggtgccaacgtgaatctacctcgtgctagagtctgagtagcctagtctatcacccaacacagataagactggacaggggctcccaggaaccaacatctaagaagggagtttggagaggggctaaaagaaagcaggttaagccccaaatgtaactgaatgatgaccagggataactatttactagtgcttttatgatttattgtaactctgtaactttcccagtatttgttaattttttaacttctgtttctcctgtacttacgagcagtaaaagttgttcaaaacataaaaaaaaaaaaaaaaaaaaaaaaaaaaaaaaaaaaaaaa

SEQ ID NO: 66 - DNA, 5427 bp, Homo sapiens
cgctgccgggccggggctgggccggagcggcggcgcctggatgccggcccggggctgggccggagactggcgcccgccccgaagcgactttcggtccccgacccgctccgcctgacccctatgatgaagagggcgtccactggagttcttgctgtcgacatctttgacaagttcaacttcacgggagccagagtcccatggttcgacgccattcatgaagaattccccagggagctggagtcctccatctccttcccagccaacttcttcaaaccacctgaagaaaaagtgcttaggtagaggttgagcatcctaatcctgaaatctgaaatgctccagaatctgaaccttcttgagcaccaacctgacacttaaaggaagtgctcattggaggatctgtgacaattactaaaaacttccccaaataaaaaggacatgaaaagaatctcacgctatcgcccaggctggagtgcagtggcgcgatctccgctcactgcaagctccgcctcccgggttcgcgccattctcctgcctcagcctcccgagagtagctgggactgcaggcgcccgccaccacgcccagctaattttttgtatttttagtggagacggggtttcaccgtgttggccagaatggtttcgatctcctcacctcgcgatccatccgcctcagcctcccaaagtgctgggattacaggcgtgagccaccgtgcctggccctcatgtgtcttaaaaagaggggtgactctgatgtggggtcatgcttgaaactgagaggacgaggtccccgaccctccattgcagccagctctctctggaactaacagagtgagaactcgctcattaccaaggggaggacaccaagccattcatgggggacccacccccatgacccaaacaaccccgaccacgcccacctccaacccttaagcagtccatctccagaactcttttcatcctgcagatctgaaactctagcccacaaaacaccaactccactccccagccactggtgcccaccgttgtttctgtctctgaatttgactcctctagggacctcccataagtggaatcatacaatatttgtccttttgtgcttggcttatttcactgagcgtaatgttctctaggttcacctgtgttgtagcaaacgtcagactttccctccttttgaaggctgagtaatattctgttgtgtggatggagcacgcattgtttatccactcacctgttgacgcatgcctgggtcgtttccacctttcggcctgtgtgaatggtgctgctctgaacaggggtgaagacgtatctgggcgtctgctttcagttcttttgggtgtatacccagaagtgggcttgctgggtcacgtggtaaatcctgtggttgattttttgaggacgcaccatactgttttcggtgggacatctgttgggttttgagaagcacctgctggcactgagagctgtcttggggaacacaggtgctcctgccggagtcctcacgctctgctcacgttgcagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggtaaggcctgggtatggggcacatggagagggcccattccagaggctcctaagtcaaaagagattccacaagtcaaaatcctgatcctgatcaagcacaggccttcacagtgacatttcactgtgaccctggcccagagacagagaccactgtcctgcagtgtccctgggagggaggttctgggtctgccacaggacaccacaccctggaacattgcacaccctttgcctggccttttcccagcgtttctgtcagaaatgccccctcccaagcatacaccccatcttgtgccccgagggactcgattctctccccacacacccgacccgaggctgtcatgggtagtgcctgctgctggccccagggttagggctgctcagccagtcctggctggaaaggatgaatgtcccacaagcagctttggggcctgcttggtgggagcagcccgaggatccgcccttcgtcctcctgccatttcccacttccctggctctggggtcctcatgttcacgtggttctcagtgactgggtgattgacccccatgagctgtcattattttggtgtcttttgctggacatttaagccattccttgtgtttctgccattagctattatgggctgtaacatctttgcacctgtgccttctttctttttaaatttctgaagtcctaatttgacccaaaggtgacacatctccctgtgtgccctgtcagtgatgaaacctgctctggggatgaagatgccgtggggcccacagatccaagctctcggagtgtgattctgtctcccctagaaacacatccatggcatgtcctcagggcatttgtgcatgggattaagcaaatgtttcctaatcatgtttgtccctgtgctctggcttcttgacctcaggctgcctcactggcccatcattaatacgtcgatggtgagcgcactggtgtacagcgagggggctccacttccgagccccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagttagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacactagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgagacagtggattcagagccatgctgtggctctcatctgctgggagccagtagtgtttgtgctttggttttgtttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacacgtagaacttgaacttcagagggtgctccttgggggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcactttgaacgaagcaaatcaaccaattaaaaaaatatattccagg

SEQ ID NO: 67 - DNA, 59461 bp, Homo sapiens; identical to SEQ ID NO: 14

SEQ ID NO: 68 - DNA, 3242 bp, Homo sapiens
ttaaaaggcatcccttacgcctttgaaaagtgtagagtatcacgaagtgtctgtgttcattttctgaccgtaaactgaaatactggtgaacaaacgtggggtgcgagcgggtgagcggggcggccggccggtgcccgctgcatccagagggggcgctgcaggcctcccttcggctgcgcacggcccgggccctccgcggctctgcaactctgcaccccgaaaggttcggtgctggaccgcggggcatccaacccgggaccgggggcgacccacggacactgaggaaactaccgcctataagcctatcatcagaacctctggcacaacacaggccagaaacaccagcatccaagatgaaggcaattttctgtttatggactgagtaccccacaaaagatcttattctgaaggccatggaacatgtctacccacatggatcaagtgggcagactggaggagaaacagtttaaaggccctgggggaaggagggagcgccagggagagctcctgaagacaacaggaattccaagtctggcactcgggagaaatcctcccttcagacattattgatgtctggccgaggagttaggaaaaacttccttgaaggagggattgaggttgagatgggcatggaacccagatcttaggcagagaaagcatattcctgtttggaagaaccctgagtacagaagtcagctcaaagatatcagcttggcccaaccaggaattcgctgtgggaagtctaagagagaaaatgctggccataatcccccaggagccaaagagttaacgaatcttctaaatgtgcctgatttacttccagaaaggagcttcctccgcagggggagaatttgacccaaggtataaaacacttggagccctgagaaaacacacagccacacataaattcaaagtcggctctggcttgctcgaagttgcaccctttcagttcctctggacagatgctatcctggactgtgcaggatatctcatgcagtagtactccctcagccagtggcttatcacacattcttgtcacattccaagtctaacacagttccgcctcatgataagacctcagatctgtgcaaaaattcatgtagaaagctctgcatttattatctcgctgattcacaacagtggtatgggatcagcagagatggtaccacagattcaagaaccatatttttctaaccccagtttgagacccataatatgacaagtgcaggatatttatggagacaacaagacacaaccgggactgccactttcaagagccatcattgtagattcaaatcaactaaaacacttcataatgggagaaacttggttgaacaggagcacatgttaacgaaggggttttggttgagaaacttactgaatcagtaagacaggacccttaaaaaggctactgtgactgcagactgaggggaagtaccaaaaataagctaatcctactctattatgctggttagaactcacagaaagcattttattctgttctacagagcagatacatattgaaacagagacaaataggaatgtgttcagagaaggtcaactaaatgaattgcaaactgaaggtgtaacagttctcgtattttaagctcctaccatgagcatggatcttcacccaacatatccctgatcctcacagtagcctggctagatgagtattttcactcacagatttcagagagagatacggcagctcggaacgctaagtgttaggatgtgaaggggctgggaactgaacgcagatgtgcctggctccaaagttggccttctttccactactccacactgcctccctgtttgaaatagatgggcatgtttggtttgaagaaaagaagccttgtggagtaagtagaagaaggaaatgtgttagcagtcctcaaatatttgtggaagcagcattagacattttattctgtatggctccaatgagtgcaaattgtagagaaacagatgtcgattcaacataaagaattttccaacataggggctgtctagagggattgggtggctcagccattttggtatgggacaaattctctgtccactgggggctgggtaaccctgtggcaggtatgcgagctctgcatgtaagacaatgaatgacctgcaaggtcttttcccatctgatgtaaaataaggctccaagatgaactggaacttggccagggtgatcctctactgaggggacaaattcacagctcagtcttccctagttatgtccctcagcccagaacccttggtacaacatgctgctttgtactgagggcaaggcaaattgaagacattatcatcaataaaatcacatcgagcccgctctcaaccaaattaaccaatgtggccgggcgcagtggctcatgcctgtaatcccagcactttgaggctgaagcaggcggatcacttcaggtcaggagttcgagaccagcctggccaacatggtgaaaccccgtctctaccaaaaatacaaaaattagccatgtgtagtggtgtgtgcctgtagtcccagctacttgggaggctgaggcaggagaatagcttgagtcccggaggcagaagttgcagtgagatgagatggcgtcactgcactccagcctgggtgacagagcgagacttcatctcaaaaacaaaaccaaacaaaaacaaattaaccaatatatccctgaagctactggtgtgttcctcttcaggcccatttttgagtaaaagtgtttggctgtaaaaagctcaaaagatgagtggcagacgagggaagcagtggaactgaataatctcttacccaaataagatgaacctaaatgacagatggttgtttctccaggtgacagtattagtgggcacccctaaactatcttcacacaccctctgcattactccacacatcccattatcccacagctggtacttcttcaccaggtactcctgccccactatcccacacctagaggacattttatccactcaaacagataaataggctgaaggattctaattaagtaatagaatcttgcatttttatagctctttaccctttcacatatatcatctcatttgtcactcaccacagtcccctaaggaaaacagctactttctttcagacaggcaattttctagctgcctgggagctaggaggaggaaagggcttcagcacaggcacagtcgctctttctcgcttttttttttttttcctgttactaccttcccacattagattatgcctccagccagaa

SEQ ID NO: 69 - DNA, 2199 bp, Homo sapiens
ggcctttttttttttttttttcaaatgcccctttcattatgaaactcttttttaacttttaatttaagttcaggggtatgtgtgcagatttgttacataggtaaacttgtgtcatggggctttgttgtacaggttgtttcatcacccaggtattattttattttcattttagttttttaaatttctttttagaggcggggtctcactgtgttttgcccaggctggtctcgaactcctcctggtctcaagcaatcctctcgcctctgcctccccaagtgttgggattataggcatgagctactgcactcagcccaccatttgttttaaaaagggtggatcctatttgtataaaaagccatgtgcattttctgtgtacttgtctacacattaatttccaggctgggcgtggtggctcacgcttgtaatcccagcactttgggaggccaaggggaggcagatcatgaggttaggagatcgaaaccatcctggctaacacggtgaaaccccgtctctactaaaaatacaaaaacaaaattagcagggtgttgtggcgggcgcctgtagtcccagctactcaggaggctgaggcaggagaatggcatgaacccgggaggtggagcttgcagtgagctgagattgcgccactgccctccagcctggacaacagagtgaggctccgtcttaaaggaaaaaaatttctggaatgatgtccaataaatcagagagagggactagaagactaatgaggacagaagcttttattcttaacacctatattttgctaccatttatattgtcatcatatgcatataacattttaacatttaaaaactagtttaaacagaaatggttgccctggaatgtggcctgtgttctttcaagggaggccagcagtttctacagtggctgagatggtaccttcatctcacacacctacgcaggcgtgcatttgtgctttgatgtggttgtcccttgaagaaggaagcagttctctttttcttttttcccttttccattataggatcagtcacttcttggggcattagtagtctcatttccagtggcatcttcccttggcaaaaggaatcccagataggacctcatctttctaaacaaatgctgttttgggtcctaaccatcccatgtttgctttgaatatgtttaagttgcctggaattatcaacaaaagaattaaatttattgtaggtcagggcatcttttgactcattgtataaaacattcactttaaatgtataccgaaatgtcctttaggctgggattacaggcatgagccatgacacccggcctgtaattttctttaaagactgccactgggtggaacccactgggcccagtgagaactacggaaaagagacccattcttgccctcattgttagtgtccacatccggatttacctaaaccccacccaggtggcatttgcatagtaatgaaaaaccggtattttctagctgtgaatcacacttcaaatcctgagcggctgactgtcaggggtgcgtcaggcctgcttgctgggagaatggacgagctggttgtggagcgggcgggtcccgccacccgtgggctcagcactggactgctcccagaacattaaaggtctggctgatgttccatgccacatctggacatgaagacccatgtctgcccttctgtagaagggccaaagaagaaaggaggcatcacatgtttctgctgtggggggcccttccgagcagcagacaggagcaaggtacaggagtggcctgattctggggtttccctgccccccctggggtccctaaactgctgtgtgatatgtttctaactatctggacagctcacccaagagtcagttgttcccagtcgcttcttgctgaggataagccaaaagagggccgggggccaatctggtttctttcaagtgaaattatgcttctcaagcagagaatgattgcccacagcagttaaaccttgtttaatggtaattaaattgcttttcttcactttgaaaaatctcttaattttctgtacaaaggcaggaagcatttttctttgattctacaggatgtttctaagtatggtgtaatcagttcatcttaccttgccgggctctgaaagaatgagtgtgtgggatcagatttagaaatgcctcaaaggttagaaagccgagtgctgccgattaactcaagctcagatgacc

SEQ ID NO: 70 - DNA, 39541 bp, Homo sapiens
gctctctttcagtgacaatactttatcaatagttccaatattcataagcagattttctatcctaaagccctaatttggtctccaaaataattatttctttccatttctaggttatatttgcatattgtttattaattataaaataaaatacactgaatgaactataatttagaaaataataaggtgttttctaacttgggctaagaagtcatctttgactaaggcttatctagaatttttccatcactgtcaatttaagaagtctatttaaacattcaaacacaatctccaccaagggaaaaagaaaattatttctccataacctcagatgctgcctcttttcttttgttctgtttgtttgtctaagcatagagaaataagattgggcaaaatggccaatatggtatctggagtcagatacaacgggttaaagtccagccttattaataacaagtctgtgattctaggaaaattaattaccctctttatatttcagtcttcttatctatgtaatcattataccagagggatacataaatgtagcaggattataagatgttattaattttaacttacgcatataaatattcaacatgctaactggcaaaaagcaagtttttaatcaatgccactaaatatgattatatcaaatatttattcatttgacagtatttattgagtaactacctgctccatggtaagggtagaatgatgagtaaaacagacatactcctctccacttggaaattcacttacagacaaacaaaatcaacacagatattcatatatggttacaagcttcaataagaatttttttaaaaagtagagaacagttattctaagaagacaaaacacaggatatgaatttgtttcggtgatgaagaactcctttcctgggaaaggtacagcacgtttatgcatgacatctctgtgatgaatagggatgaactcaggaagggagcagttaaggaaaggatagtctctatgcaaagaaggaaaacaactttgtgagttccagaggcagtgaaaaattatagggaaggatattaagtctggaaaacagagggtaaggggaaggttggtaagtgaatggcctacatagcagacaaaggacagagcattcagaaccaggtaatccatggtacagattgtcatcagttggcgtccatagtataaactgtaatcagcgagtgttggaagtcctttggtggggaaaaaggagaatgagggagtgagggatgtggaaaaatatttcaccattcttaatttttattgacttcagtgtagagaatggacttgaggaggcaaagataatgaggggaggtgataagagatggaggttgcaaaactagagttgaaagaagatcgtagcttagattaggcgcagacaatggctgtgaagagatgtgggacatgcataggaaagattttctaagcaaaagcagcaattcttgaaagaatagtgaaattgaggggaaagaagatattgaccaatgtgaccctggaattctggcttgcacaaactaattcgtagaaagctattctctgaaatacagtagaaggaaattgagcaagacagaataggaattataagctcaattttgtacatgttatatttgactggactctatgacatctatcaaagaggtcaagaagagaggtggctatgtaagactacagttcaggagaggggagggctagatttagagatgcaaatctgtaaagacagtttatggatggtagctaaaaccatgggataaaatgactgcactctgtaagaattcagaatctaaaaaagcaagcagttaaaacatgacatgtcttctcccactcacatcactataaaatgcaagaatataaatattgctctttggtgttttagtttactacatatggaatcttgggcagaaatatccacaacaaaaatatatggttatctgaatatccaggaaatcatatactttctaatgtatatttagacagggaagtagagaaattaatgattaataggccagtgaactattataggaaaagtattgtttatgtggtcaaggtagtagagcactgagatttatttagggtgggatgcaggtagtgagcatttaatttagtaaggtaagaaaaaggttgggttttggccctaaattggtttaccacaatatttcccactacctttatgtttcaagtctatgataatttgacctttccagaattctgagattgtgagcaactttccccaaatgtcctccatctgctgttctaaccggtttactcaactgagctagtcatacttgtctaaagcaatgttctaactagtataaaactaaatgaataaagagaagatcaataaaatgaataaagataatgtcagagaaagggccaactcatgttttatatgtaaggattaatttagcagaaaagtcagaatttgtaaaatacaatgctcattattaaatatgacatcattgtttggtgatatgataatgacctaagtgataaaaattgtcatacagcattcatatagtttatgtagtcactgatcatcataaacaccatgtagcttttctggatgtgctgtcacagaaaaaaattaaatccacattactcatgattttgcatacatttctaaagcataataaaatttccattcagtattttactttggaaatgctgtcttttctgggcagtgactcctacttttactgcatattaaaatattatatactgataatgattaattgctagttttactagtgtggttttcaatcaatcatgagcagagaaccaattctctatgaaaatttaagaacatataaatccatcaaatacatacagtgctagctgatttgtctagtaagaaactagactaaaaataaaattggacctgattttcaatagtttacacatgcctaatctcataagataatttgattccaacaataaagatgattttggttggtagatgggttaatttaggaattcttatcactcacaactctttgtgaataaaaataataaactattttcaaaagtaagaaacttgttaagtctggtgttttttccctaactaaactgtttgttctgttattagttttaatttattataatttcttaagtcactactccattaatgttttcaaaactccaaattacataaaagtctttataaactactaatgctgaatatgccttattttaaaatgtatttggtataaagtaaactttaagaaaatatgaaacattaatatttctaggagcttattcaaagaatttaaaaattgacaaacacacataatgtttaaatttcttcctgagctgttagagtctcaaaactatcagttttaataaaatagtaacagataaatacttaacctagtttccttttgaatatataaggtgaattgcttaatgtttctggataattcctcccaaaaagtgtttatatttactcaacaaaagggtataaaaatttcagtacatttgattttttaaattataaaattataggtaactagcatattaaataacttttaataacattttataacttcatagtattcatagtacctaacgttataattctttttcctaaaatatttcacttaatggaatgatagataaacttatatttaggtctcctatatatggaaaaaccattgacacaattgataattccagattatacttctccctcattaaaattatcttacattatagtacatgtcttaatataacattagaatatgttcaatctctgaaaattaaaattaaaaaatatatataatgtatataattgaaaatttttaaggatatttttaaatctataaccacatatgtcagcataattagggagcacatatatacatacacacacatatatacacatataggttatacatatataattttatctattctttttggtacttaatcaaatttataagaaactgattcaatcaaccaaaagactaaaaaagatgcttctgttactaatttgttactgtgtagtaattaaaatttcttaatatatacattatcattttcctatatttctcctgtagttcttctttaataatgtattctgatatcacatgaatctaaatgcaaatcatttcatatcctgactatattccaaaaccagtaatgatgtggtttagaatagtaatgagtcaattctctcaaaatgtaaaacttgggagttttatgtctatgaaggattttctgtaagtctttaaagtagcagaactctacacaaagaagcataatatttgaaataaactagaaataaatattgagctgtttaccaaggagacaaaatttcaatactgagccaacaaatcacaacagctaaatgcaaagggactccacgacagtttaactcaaagacttactctgaacaaggcaagagtgaacacaaagtaaaaggaccagaagagaagttgggacagagaataagacgactgcatttcaggagcaaaaagagaggtaaaataatgttgctgtccagtggcctcattttgtccacctcattactcctggaatagattcaaaccacagggaccttagataatatgctaagtcagttactaggccaatatatgagatgcattctgatgatgtgtaaagcaaaatttcatcttcagataatggaacgactgatataatttaatgacggtagatgacagaagaacaccataatctcaggaatatgagaactattccacttgaaggcttacaaaaatgcatgtaagttcaattggtggctacaactttgaaaacttccaaaaagaaaagtgaggtgtctgaaccaatagaaattaatgagcaaacttgtaatgaaattagaacttgagtaatcaaaaccagggtggcatctcttaacccacattttcaacctgaaacattttagacttagtagccacatgagcacacgcggtgaaatgagtggaaattgagagatgcttggaagccccgtggggacttactgtacctgtgtccacatccttcacctgttgcctggctagagttgtctggctccactttgagctcttgcagaaccagccctttttcgtgtggtccaggaaagtccatgcctggcaccacctcctcctctagtgactccacgtagaagagagtcctggctggctgctgagtgccctgcccaggagccccttgctgcagcctcgtggcaactggaagcagggtgccattcagcggattgaaggaagaggaggaagaggacggggaggacgatgaagaggaagaggaggaaggcttcttccagaaagtgctcacaccgcttctctcttggcttttgagcaggcgactctggctgggtccccagtgctcaaagctgccactgccgtcctgttgcaggcagcctccccccgccgggccgccggtggaaggagacgggtggctgaagagtttccagcggagtcgcagaatgtgcttcacatcgaagtcttttcgcccagagcctgacatgctttacgcacagaaggcaaaaggctggcagctcacgcaggagtaggctggtcagcaggtgggggaggacagcggggcccgggggcggaggaagaggcgggatgcgccctctgcacccctagagccagaagacgctaggtgggctgcgcgctctgccaggcgaaggctggagcgcagacggcaaagccgcgcgtttcagccgtggtcgggtccgcaggacctgggcgtggggacaccaccaggcaggagcagaggcaggactgggacgccaaaagctgagaatcctcgatgcccgcgcgagagccccgtgttatggcgaggtgggacaacccttaggctggagatgcgcgagggagggaggtctgagcgctccgaagctccggaggcggctgcagctggatacacctcactgggatgcgcttgtggcagagccttagtagggaaggtggtggcgttcttgtccttgcagctcagagttcagtgtctggagagcgcagagagaaagagccccaagtctcgaggaagcgtacccctcgccagatctcttggtgcacctgcgcccctgtccctggccttttcgaggatgccccgatagcctgccgggtggctctgagaaagtcaattgctttctgcaatgccagaagaggtggttttatatagtcagtttgtaaaagagaaaaatagatattctagcgcatatagggaggcaaaagaaaaagcccgcctgtgaagctgtcaaggtcctcacagtacaattttctctctgcctcagcgcctcctcctcccctgtaagtgacgcagatgtgcactggggcctatacggagagatggagggagggagggagggagggaaggcttcaatcttctttatgcaagtgagactgctgctcttattgtccccttgcgtgggtcttgtcaccttttttcaccctccttcctcgctacattactgtgtagcaatacaaggaaagaaaacaggcattatgcttttgcatcagtaaacaccacacatgaatcatggcagtgtaaacttaataggctgccatcagtttgcaggttgcaggttaatggcttgaattatttaatgaaccgcgtcttttaacctttagccttagtttctctgtagtgagacacagaagaaacggatgctggcgtcaaaatgtgacgatgccaccatcctgacacttacattgtgattctgctattaaggcacccaggcactgcttcactcctggggccagaggcgtacggtagaaatttgaagatgggcatctgaacacgggggacgggttttgcgaaatcagtgcatttggtgtgtagcctcggaatgaaagctgttatcagtgtaaatcaagaatggaataaaatgataaaagagaatttcaaggtataaccttctagtacataaatcattgtatactatgcatggaagagtttaggcaataaatgagaatagccgaaggctacttactatcttgcaaataggcgtttggagaagatgtgttttccccttatatctatacttagaatggtgaggattgcgatcactttcagtacatgactacttggaatgttttaacctttcctttaatgagccattaagatagaacccagtagtctttgttgaaggcaaagggaccagaaatgcaatgtgttccctaacttaaccaagaatatggttgttgtccattcatgaaattcacagtttcagtaacccccaacagagcataggaatcaaccactgaagtgcagttaggctactgctcagttacccccaaggttgagctgtaaacgtaaccagaaaccaaagctaaatttggagtccttaggcaaagttggacgctttaataaaataagaaattaagtgcacaaaagacctatttttaggggaataaaaatcactatagtgcttttaaaatattgatttatgccacaacagctggactgcaatcccttgtgccttgatttttctctcagtattcagtgattttttgtttgttttttgtttattaagcaaaaaaccctttaaagccaacaatggtgacagatcatttttatccaacaatggaatcaagtaagcatttcccttagggaagaaaatagtttatgaaattacacatcacaaacaggacagaggaaactttccatcagaaataatgttgaaagttgaagtgcatgtaattaatttatatagaaattagtgcttcatggattatctcacttgatttatttaaaataatataaaataacataagtcaagtctctgtatctatatttttcattcaccattcacaaactgtaatataaaatttatttgttattctaaaatttaattttgcagttcctttttctctgcaatactaataagaatattccacagttaaaagttatatgtttaaaggacaatattttatatgacccaaaggagatataacattaatttgtggtataaaggaacatgaattaaaaatattgtcacatttagcagatggtgaataaagcctatttgttagtcttgtagtaacatttagtatgtttaaagcactgccagagccaattatgtaaatataggtacctttctatatttgtcaatcttaatacaatatataagtttgaaaaaatcactcttcttgggaatatatttaaataaaattcaactttattatcaaatgaaaatatttcgaatttaagaattaaattacgcatgaagttatgttaaactgaaatgactgacaaagatgattatattattttcacttgattgttaccatactacagtgttgtagaaaaggaaggagaaaataaaacaagaaaaaaaaatggaagaaagagaggaaagtgagaaggacgagaagagaaggagaaaaaagaaagagggagagactgcgagagagggaaagacagagacaggaaaggaggaaggaaaataatttggttggatattatggcttaacctggcatattagataaaatccttgaaaaatatactttgtaaaatactgcactaattaatttatctattattcaaaaataaaaaactttgattgatcacttaggtccaatgtaaactagtaacaaatatgaaggaattggtcccatgcagcttgctggaagaacccacaaaagaggactgtttaaccagccataagtaataattgacttgtgagtcaattaaattaagatttaagataaccaagcttataggcaagaagacattgacataataaagaccacttttaacaatcccaacaaacacactttgttttaaagacagaaactatttaattattctaacactattgaattaaattgaactgtcagttgaatcaatcagagtctttcaaatgaatgtccatatggttgccatagtttcctgaaacactaagcaaaaaggttaatcgggatacagaaaatctgtagaatgctcaagtatttactgtaatacacaaatacaaaactcttcgcataagtattaagtcaagcatgggtgtaaaatgtatcacactgaaagtttctacaactcaaatatttaaacaataagcaaaattggctttggatctgttttagtccattatctgttacttgtaatagaaaacctgaaggtgggtaacttataaagataaggaatttatttattatagttatggaggctgagaagtctaagttctagaggctgcatctggtgaaggtcttcttcctggtggggactctctgcagagtcctggagctgcacaggcatcatatggcaatggggttaagcatgctgtctcaggtccctcttccttttcttataaagccactaatcccacttccatgataacccattaatacattaattcttgaggttctgccctcgagacccaatcacctcctaaatgcccccctctcaatattccacaacagagattaaatttcaacatgaattttggaggggacaaaaattcataccatagcagaattcaagaattttctagactgaaagcttctcacttttagtgactattttctaaacaagcacaattaaatgtatacttttccaggaaaagcaattttttttgtatctttttggcaggccttctgcaatgcctagaaatttcttctacatgataatactcaacaaaaacatttgaatggctaattatgctcaaatttgaaagttcatgccttaaaatggctcctgtgattttgtctttgattaattttaataagatgtatttatatacattttattagtcaatttttgcactgctataaagacattcctgagactgggtaatttataaagaaaataagtttaatcagctcacagttctgcagagtgtacagccttctgcttctggggaggaggcctgaggaaacttataatcatggcagaaggcaaaggggaagcaggcacgtcctacgtggctggagcaggaagaagagagagctaatgtaaaggtgccacacactttcaaataaccagatctcatgagagttctatcatgagaacagaaagatggacgcccacccttatgattccatcacctcacactaggatcctactctagcaccggggattataatttgacatgagatttgggtggggacacagagccaaaccatatcatacattaatataaaatattatttaaaattagagaataccatttaaaataattatatagaacttttaatgtatacattaaataaaaattgttttgcagtgactttttttcccaaaatgattgaaacataatatcatatagcactaatgctaagttatcccatgcataatcaagggttcctacctcttaaaacaaatacacataaccattcatggtctattaatcttcattacagtatagttatagtttacttaagtgtcaattaagtgactgcttaataaacatttgtaggtattcattgatccccaggggccattttaatccactcaacctccttggtttatttgaccttttgatttagatctggcaatacatttgtatagttgaggaattcttatataaattgctgagttaatttcattagtatgtgaattcaaaatggcattaaaatagtgaatttctattaatgatgagccaggttttatttgtgtgtctttttatttcccaaaattctgtgcagaatattgacagtggtttatgaacattcattattttcacttttgtgctgggtcctgtctggttaatcacactgctgagggactttatatatataattttttttttttttttttttgagatggagtctcgctctgtcgccgaggctggagtgcagtggcgtgattcctgctcactgcaaccttcacctcctggattcaagtgattctcttgcctcagcctcccaagtagctgggactacaggcaccaccaccacacccagctaattttcgtatttttagtagagacggggtttcaccatattggccaggttggtctcaaactcctgacgctgtgatcctcacatcttggcctcccaaagtgctgggattacaggcataagccacagcgcctggcctatgatgtgatttttaaaacactttctatcccttttatgaaaatatttatagattgaaaacaaatatatgtagacatatagatatagataaatgtaatatacatatacatttaataagtatttcaaggatattttctaatgagtaaaacacatttgatggcatgatatcctattttgtataacactagagtctttaaaaaagaaaactgcttaactaatacttatttacaaagggttaagatttccctagcattaaaaaagtaatttcattattttgtatattgcactgaaatttgcctgtatcactgtggggtaaggtgagtcccctgaaactttaatcaggatgatcaaaataaaatagtaagattatagtttataaaatacagatttggaagttataggagtgtaagatattcatataaatatagataaaatagtataactttgtggatattttattttctgttgtctcttttgagacatgggtttttggagactttaaaatattttctcaaatcaggttactacatttctctttccatcttgagacatatttgccaaaactttatattttcattcacctgcattattaccagatcttttaaaaatctaggacaaaaatgcatggctttaaaagctaagatctagtttgtcttaacataattctaattatggatgtaacgtaaattacaaatagttttcaaatgctctttttcccacaagtttatgtgtaaggaatatgtgaagttataacaccccaaaacaacattttttagttaatctgttttagaaatagtactgtgatttttatttcaaataaattatatattcagagtattgggaagattattctaagaaatcaaattactttgaaacattattactagaagtaaattggcttccaaaatctaatttgaaaatcacaacttgacacttaatatattttcctcagttttacacccagtcaggatgcttttggctcaccagtcccaaagaatattacttgtcagccccatgggaagctaacaagttgaccctttgccttgaagactgtctcctgcaaatgtggtgacctctccctttctgtataactctagtcactggccatcatggcacatgtaaattctctttctttattgctcaaaggaaatatgacatggacttcacacaataatatactaaagtctaaaaaatattaaaacagataaatctgtaaattaaagcatacatataattattgaaatcatagcctacttaagatttcatgtgatgtctaggacaaaattacaagtaaaataatagcggcaaaaggaatgatgagttttcagattatattacattctttaaatttcttcacactagatagattcccagattaaacatagagtattttcttcaacggttatgtatgaaacattttatacatcatattattattttcttcttagttggataatgactcaagaaactaagaaaggaactattattttatgacatcctaccaagtgccagacaatgatttcattctatcttgatacaaatcttatttaggtaggcattataaaacaggcttaatatgaaaagaagtagaatcaactggccactaatattttcttatattaattgttttagatactcctccataagccgtactttttctcctattttaaaattaacgtatgagaactaaaaaaaatgacaaactcattaaaggcagagattctcaatatcatttcctcagctgtgtgagctctgcttgaatagaagagagactcctggtattctcaaaattgagctctctttctaacgtgtgtgtgtgtgtgtgtgtgcatgtgtgggtgtgttagtcccttttgtgctgctataacagaacactacatactgggtaatttataaataacataaatttattctctcatagttctggaggctgggaagttcaagaccaatgcacgagaatttggtctaaagagaatcttcttgctctgaacacacatagtagaaggcagaagggcaagagagagaacaaagtctgtgtctccacatggcagaagagcagaggagacagaacctactcctgtaagtccattttataatgtcattaatccattcacagggagggagtcctcatgacagaaacacctcccaaaaggctcacttcccaacactgtggcattagggattaagtttccaacagaagaatgtgaagaaataagttcagaccacagcagtgtgtattgttttcaagtctatatgtatgtttgtgtatttgtgtagatacatgggtggctatatctctatagaaacaaaagtaatggtttttttgggggggcaacacattttggaaaatgaagatggtcttactagactaggatggttctgcagggcaaagaacatgtcttatttaattttgaattcacagtgtctaactgtctatcatggcatgaaacaccagtaaataatggatggttttgagtttatcataatgagaaatggataagagtaataacactttatagtggaggagaggtcaggaaacatataatactttttttaaaaagtactgtgaaactgtggttctacaattatttagtatgaaaacaaatagaattataaaaatagtggtttcagaatattttggtgccctcatttgtatttctaaagtactataaaatactcaagaaaaattaagcatatattatgtatattcagtttatcaaacaggaaatgcaatgtgcaagttaggaagtgcttttattgtaattctcaaaattgtatttttaaatcaagaaagaaatcttcacatttaaatccataagctttagttacattaaaaattcagtctctgcattatcatcctttcatttattcaaacacattttttattgagcacttactctgtgccaagccatgttcatggtgatgggggtgtatcagttaaaaaaaaaaaaaagtagaccaaaatctgtgccctcaagcaccttacattcttgaggtgagagatagaaactaaaattcaacaaatagtaagtgtatcagataatggagacatcatccagggagataaataaaccatggaagaaatacagagagttttgaaggaaaggggggctgagctttaagtaatctatgtgcttaagctccactgataaggtggtatttctcctgtgtccaaaaataagtgaaagcatggactgttcgtgtatgagcgacagtgccatagcagaaggaatagaaaagcaagggcctggggccatgataaagtttggtgtatttaaggggtaataagtactagaagcgagtgagcagaaacgaaacgagctctattggagttcaaggaggcagcagacaagataccagatcacttacaggatcttttaagccagtgcacaaatattagtttttattctgaatgagatggaaagccattggaggatttggagcattggagtgatagcatctgacttccattttctaagatcactctggcagatgtgataggaataaacagaagaaagcaaggtagagaaaagaaaaacaatggacagactatagaataaagaatctaagagatgatgtaaatgtggaccagacattgttgccaggtctggcattcatagggaatcgattttccctaaagttcatggtctttttcttttcatttttagatgggaagctatgttatagatagtcttgtctatcttttactcccctaaaataactaatttccctatttttttctgttcttcactgatgcagaatgctcacataaacctaaagcatgttcaggtcttcctcggctatatattcctacaagataaagtaatttatattttaccctgatttacaaaagagggtataaacttgtacttatgcaacatgaatatgttttatacctaatttacggcataaggactatagtcaacaatgttctattacactagaaagttgctaagacagcagatttggatgctctcatctctccctgtctctctccttctctctcacacacatacacatatgcacacacaaaagtaaccattttaggtgatgaatatgttgatttgcttaactgtggtaatcagttaactatatatacctatatcaaaacatcatgttgtatactttaaatatatacaattataaaaatgaaaaaaactatgctttttcctggtgcatttcaaatttagctagagggataatcaaagctcttcctcactcttcaaggattgacaaaaatgctatgggcagtgcaagaagtcacagcttgagcagtgcatcctataaagatatttgcataaagcatttaaattataacatttgaaaaacagtatgtgcattattcctcctagttgcctactgactggaaagcaacattgtagaatggaacgtcacaggctttgaaatcaaatcatgacccaaacccttctctgctgcttacaatttgtataaccttgggcaaagtacttaatttctttgagtctcagctttcttatctgcaaaatagaagttaacgtgtaggtcaaataaaataaaacctgttaaacaagtagcacattgttggtgtctaagtaaaggtagatattgatgtttactttgaaaatatttgtatatttaaatgacctttatattgttgtaaaaaaaagtttaaaaataaagctttcaatacttagttggctttgcaactttcaaaggcattttgtaaaatatccagattactattcacttgagtattcacaacatagaatcactgattaatcacaacattgattttttggtgagcttgtagttttgtaagtcaatgacaaaaattgaaaatcaatcttttacattattttgttctaggaatagtcagaattcatagatgtctgcatattagggatattctaaaatcatttcaagtaggagaactgtaataaaatatttgcttcagttgacaaatcacttaagttaattttatcctctcctgtgagttgggagaataatgagaagttaatgaataagtaatttagattacaaaaaaaatcttggcaatagtctgtaaggaacttaacagaaatgacatttcactaagtaaatctctgatagtgtgagtgaaacaataaattttactaggaaaactagaggttattttgtcagttatgaaacctgaccattaatatttattgaactgggtatatggaatttatggatattatctaccagatataatgcattataaagccatcattgtgggattttttgtagaaaaaaaatttattcaaatgacatgctagtcacatttctggttttgagtaagaatgccatatatacatatatgcatttatatatttcatttatacatagagaggaagagagagagagactggaaatttttttaaaaaattaatttgtttcaaagaaacaggctatcagtaagctaacttttctacacttatgttatttttatgactatcacagaatgctagaataatttgtattataaaatagacttaaaatttcctctgattttgtagattcctgcctgtggaaactaaaattggcacttatattcaacagaacaagcttaccagaagattcatttattatttctgatatactcttacagatatatacttttttttttttttgagacagagtttagctcttgttgcccaggctggagtgcagtggcacaatcttggctcagatatatacttttatacgagcattgcaaacccagactatagatttctggcactcaaaaatatgtcaagccatggaaagctaattgaaaccactgaatatttcaataaatcaatcagtcagtattgagaatcagctgtgtgctcagccctgtgcagtcaagtggacagggacatatcttggcagaagacagacacacacaaaagaaggattgtaaagtctaactaaccccacaaaaagatgttttaaacccttactcttataatatacatacagcttatgcatcagtttttcacaattatttctcatgcttgtctctcaaacttacaaaaatgaggtcagagaggcctagttagcaatcacacagttctctagcaatcacacagtcagccctacaggagtccatttttttaacaagagagaattttacaggctatagagagttataaaattttaattttcatatgcaacataataactcttaaagttgcttactttctcttataagattgtctttctctgacccagttctgagccccattttcctctgctctgggttgtgatctctaataaatctttagagtaaagctgttattacagtgtgaactgattgttctctattcaaatgatatcgtgtgtatacatgcacatggagtttgaagggattcaaattacagtgaataataaaaatcaataactttaaagtgaaaaaaatacaggttgaacatctgtaatatgaaaattccaaacccaaacagttctaacatctggaactttttgaatgatgacctgatgacataagtgaaaaatttagcacctgacttcatgtgacaggcagaagtcaaaactcagtcaaacctttttgtcatgctcaaaaaaacttgaatattatgtaaaattatcttcagactatgtgtataaagtcagtgattatgaaacatgaatgaatttcatgttgaaacttgggttccatccacaagatatttcatgatatatatgcaaatatttcacaaaaaaaaatgcaaaatctgaaaacatttatggtcccaagcattttggaatatgtatatttaacctgcagtttacatttacttatttttgacagacagtagtagttcaactcatgtgacacgtaagaattgataggcattaaaaaggtaaataatttaagtggaatcaacttatagcagacattgaactccacatatttgcaattttttcttgttattttatcattaccatggaggttatgggagttttaaggtgtcagtgacccacattacctttaatatgtcccctttcaataggatatcccaaaagaaaataaaaaggaattttaagaatgttaagatatagttgagcaatggtttcaatgatgtcaaaaagattcaggagaactactatacaaaaaatagagaatcagtaaggagaaatctgctgatggcctttaattaagttagtgatttaactaatgtaacatttggttagaacaagaccatctaatatagacagagttaaatttttaataataatttagactattaggaggaggccatcaaatatttgtcattaaattgttggagtctattcagtcatggaacaagtatttactgaacacttgctttaggcatataaccatgcactataaagcaagcttccactatccatacagagcttgcactttatttagtgagaaaaaccgtaaagaactaaacaataaaaatagctcaatgttttggtaagtaaccatttggtgaggtggaaaatgacaatgcactgacagttctctgctttaaataaaatctgcacatatacaccatggaatactatgcagccataaaaaatgatgagttcatgtcctttgtagggacatggatgaagctggaaaccatcattctcagcaaactatcacaaggacaaaaaaccaaacatcacatgttctcactcataggtgggaactgaacaatgagaacacatggacgcaggaaggggaacatcacaaaccggggcctgttgtggggtggggggaggcgggagggatagcatttggagatatacctaatgttaaatgacaagtttctgggtgcagcacaccaacatggcacatgtatacatatgtaactaacctgcacgttgtgcacatgtaacctaaaacttaaagtataataaaaaaaaaagagagaagccatccttgtcaacttgaggttagaactgatctaaaggagagaaaagataaaaaatagaataagagatagaaaagacaaagagaataaataaatggaatctgaaaaatacaaggaaatgatcaacataagagcaggaaacctcacaaattagacagggaatgactactgaaagccactcgggtagcaaagaggatgggatatcaaaggaacataaagatcactgctcatgatagtgtgggaggagagggaagagatagtgttagagagttttatttcatagcatagagtttgattttaattctatctccaatagaaactgagtgaagtctttcaaggagggaaagggtgtataatttaagattttaagaaaggtgacctgtattggattagagaaagtaagagtcaaaagaaagaaatgaatcatccggaaatattttttttctccacccagagactcaataatgtagccaagaatcattcagtaacaaggttcagaaataagaagctggagggtattaatgctttcattcatacagatgagctctcttaatttaggaaatgtagaactagaattgatatttcataaatagatatgatttacagcacaagaaattgtatattctcaagtactttaacatatattatcttatgttataaactgtgatgacttttaaaaggaaaatagcgatctttagaagtgagagtaaaggtaagatcttagagatgagaagcagcacaccatgggaaaagcaagaagaaggaggaatgttatgtgcaattaatcgggtcaggaaagagattggtataatgaatgaattgaaaggattttgtgggatgaagtaaatttgaaagacagcagtggcagttattaatatttttagattattaatctaaagatttaaaaattatataacctgtgcacattttttatttgtgtcttgcatttttagaattatgttctagatatcctgaaagcaccataccacactaatcccttcttgcacaaattgaggaaagatgttcataatccacaatgctttatcccaagaaagaacaatagattttaaacctatattgccaatataggagtgcaactgacatgtgtcccagaaattgtacctgggaaaactcaaaaattttactctaccaccattctagcctcaattcctctgaagattaactcaattctattgtcttttgttcatctagtattacatctttaacttacaatttaaacttcctaaatgcaaagttttctaacactaaagcattagtagtccattttgtcttacgatttaacttgagagttatacagctctaaataaaatgttattgtaaatacttataaatccttgaaaattaactgaataaaacatgcaatgtcattcattatctcctgtccttcttagagagagatctacatcaaaattatctcaaagagaagattcataaaacaaatgtgtacggctgagaaataaataaactgaaactctccatgagtcaaaatgacatttcttctaatgtttataaaagaaacataaatatttgtacatttttatgaaactatggtatgtatatttgaggattctttcaaaacagtttatgtaaaacgtaatagaattcaacaagtccaaagataagaaattgaaataaggaagggttcaaggaaatgactcaaagggagagatacaaagataggcatttgatcttggttaaatgagaggaatattataaaaatctaccaaaatctgaaaatgatacagatagatcttactctgaaagcaaccagacctggattttaattccagctctagaacttactaacttgtgtaaacttgaaataattccaaattctcttagagactttgttttctaatttgtaaaactgaaattataatacttcacaagcttttgtggaaaaataaattaaatatatattttatcataaggttcaacatatagaagttactgagcaaatattaatctaggtcttcctatatcctgtctctaaatcgaaattctccatgataaatacattattaagtaataagtaaattgcaaaactcttagattttgccagatactatagatagaaaatattactgaagtttaaatattgaaataatttactgatgcccataagttgtaactaattgaagttgatgtcaaggaataattgtgcatcttaacaataaactctttaatggcaattttagattattacattgattaactaatagtaaagtacagcaagatttatgttgtcaaaatctttggccatcatctctagtcactagagtgaatattgagagtaaatgtgaagaatgttcaaagttgtatttactattgaaggtattacctatttttagtgtgaacacccctatgttcctacgacatagcctaggtgtaaaggtcaccttgtgaaggcagtggacagttggtgaaggcttgtaccactgtaactctgctaaacttagaaaagatctgaaaatactactgataggtaagatcctatattctgtccacaaaaatcaaatgagaactatttgggtaagggaaaaaaatcccaaatatattatgttaagccaataacaattcaccattaagtaatgaaaaatacatatcaaaaagagaagtctaggaagaaaggagttatttgtacacagaaaattctcataataaatatttaacttagtgcctgaggttgtcaccaaggatctcactttttgaattattgtatttatttaagatcagaatatataaagaatatataacattggtgttatttgtaatttacagttcaatcgctaaaatgtcatttcagagtatgttaaatttaaggtgtaggctttttgaaaataagattttccttgatgaaatacaaacaggattgaatttattttgttaatttaatttgtacataatagatttagagacacgacattaaatctagtgaaaagcatttgttattaaatttcacatgccatttttctttatattatttccttagcatttaaagaaagtataaagaacatacagtcctgtattattttttgcctttgtgtattagcaagtaaccatcatttcccaagcaaatattggtgggcggtctcagctctttccttcccaaaacattaaataattaataatgtcacctgcttcacacttttgtgaaacctattctagatgctttatagcacttacatccttgtgggaaaagatacacaagcaaatatataagtaaataatgtcacgaggttgtgtgcagaaaaatgaagcaaccaaataaatagagaatgctgagtggagctgcaacagctacattagatactatggttagagaaagcctctctgataagatgacaatcaagaaaaagcctgaataaataggtaggagggtggacgggagtttagcagttaccaacaggcatgagggaagcaattgaaaagactttagccatgtgtttggtaccttagaaaaacaataaaagggagggaaagtaattaaatgaatgactcagttaactgtgaactctagtgatagaagatctcagtagcactcaatccccttgttttttgtttgtttggttgttgttattgttttttttccccggaaatctggttttccccaagcctcgccaatcaattcactatttttttcaaccactaattactgaagatatatcgttgtcatctcctttgtacactaatagtctagctttgaaatacagatatataattgcttgcatagccaatcttctatttaattacctttaaaggatttttaatttcttctttattctctttcatttaatgttattctacaatgtgtgtaatttgagggtttttttttttttggcttgcattcattctaatttaactcaatgggctgtgctgaagttcttagtggttgtgtttggtttcagctctttttaaaaaccgcatatattttactccctcctcttcgaatatcaattacacgaagttgtaaattatggaggtttcattcaccactgaatttttagggtatacctatcaattaccctaatttttaaaaatcttttctgtaactcattatctttgtatcctctgctatttctcaatataaactatatgcaaaatacagacaatggtattatgaggtcttatgtacccttcatccaaactttattttctttttatggacaatcttcttaaatttctacttctatccacatcacccaactacttgtcaatatattttgaagaaaatcccagaaggtacgtcattttagatacaaacatatttatgtgcatccaatgaataagagatcttttccttacgaggtaaacgccataccataatcagacaaaaattacaataatttcataacatcatcaagtattcaatgggtactcaaatttccctatctgatatttctccaggtttgtttgttcgaattgacactcacataggatatctacctattgagtttttgttgatgcccatattttaaattcctaaaaccactattttacacatgaactggaatacttgtttttccttgggtgagcttttgttttcttttaggtagtggtgagttttctgaaatgtttgatgatgtttggttgcctcctcatctttgttctgagaatttctgcttgcatctctatcaatcagttgcagatattgatgccagggatgtttcactgatgcacagtcagctggtctgtgctggcttctgaatgtcaggtctccacattcctcctagactttacatataaccgagaatacctgctctgcttctcttactcccaaaccccaccaccgggggttgtgggaggagggcagagggacaggggtacaaatatgcctgtttactttagctaaagacaagcggtgtgatgcaaaggagaaggggccaaatcatctggtgctactaacgcaggctcgcaattgccatcctgactattacaagaaggaccttcctggttttattttatctttagaatctgtgcttgtagcatgcttaggagtgtccccaattccgcaattatatatttgtacaagtgttaacatctgactttctctggccattgtaagctcatcatctttttactttttcaatatttccaaaagtttatttcctgtccatgatacactgcaagcaaagtaatagatatgtatacataaatacaaagatacaagtttcataaatagatacatggacagctaatgttccctcactttctcatggtacaaaaaaagctaaacatatatatttcctctaataccaaggaattcatggtaggatatgaggtgggtaaggtgcttaatctgactgatagattcaatacatggcctatttatttctaactataaattaggctaagttgtgctctctctttctccatacaggtagatgaatagatatagacatatgagtaaaccatatatctctctatacctatctatctgtgtatatattatatacataaatagatcgatgtaaactatttctatctatctagacatattatatatatatatatgaaatcttacatgggcaggtagatagatatatctataggcagatagctatgtctcggtagatagatgtattacagtttagatagatatgtacagtttacacatctataaatagacatctataaatagacataaatggatatctagatctacagatttctatacatatctagatctatatctacaaatagataaagataaccttatatctgtatatccgtatctatatatcaacagatacagagtttacacatttatagagttttctatagataactctgtatctgtaacctctgtatctgtatatctatatgtacctatctatatatacactatatatctatctatagatacatatatcaactataatatgttttggatttatatacagttttgtattatgaatcttaagctctgtcactctatctctctgtctctttctctatgtctttatctatttccatctcagagagacagagacagaaagaaagtttaaaatcaaaaactgtaaataaattcaaattggataatagctcaataatttatctcatttttatgtcacttaattctttctattatttggatatgcatcaatccttaaaatagctatgacctaatgagatggaaattgctcaaggtaggagatctagatcctattaactttgtgattttagtaagagtattgctagctgttctttaataatgaggttaaaactaaacttttaatatgaagatttctaagcataataaaatgttgttatccttgagaattagatatcatcgaaagaatattaagaattatgcacataattaattgaaataaattaacttagtgttctaaaaataaactaacatagagaggtatatatgtaaatgttaagatatatgaccatgatttctataatcatgtatttcataaaaatagaatttcaaagacattgagaatattgactttagaaaccagattgaagaaaaaagccatgatgctacctgcccacaacacgtactttcaccagatatctggaggcctgacatatgaaaacaaacatttttttttttctttgcctcatagagcatagtgaaaattttgtgggtgtagttagagagtacaaacatcaaatcattaatcatgttattaaaaagcaatactgtctaataaaaattaagcagtgcatttcagttttcagaattatccaagcagaggctaacttattcaagcagaggctaaacagatgacaatttattcacctgtttacttaattgtagatagaattcatgatttaagagaatgcgtgataaatgagtgagcgagttttcactaacactccttcctgctttaaggtactttcattttatgttgttatataatgaacaatgttgttacatatttattttactattttattaaattatatataattcatataattacatatgaattttactagggataggttagtatgaaaaacagtttatagaaggtttacattaattgaaaaataaccttttgtcatacttttgtttatttcgccttacaagcttaggcatttaaaacttgatttacctgaaagttgtttcttacattacagacatccactaatggctttattgcctgtctaatggtcattaagtgaaaatgggcatctagaataacacagctggggtccactttaccaagattctttttaacacagttggatatctacatgatgttcatacccactgttctttctgaacattagtgccccataactgtcttttacaatgtaattcattttctttcttcacttaactctgttgaaggaatcaaaaggctgaacccgtagttgtactaagaaggggagggcaaatggtcttgaagagtagaaacaccttactttagaggtagcattaagatgagcttctattgacttgagcttaaaaattaaaaaaaaaaaaattacaatctcagtagtgcatttcaaaggctcagaattattgattcagacataaacccatgtttaaaaatgctaacacatatgcagtgtaactagttttaccaactggtatactgtttcccataatgcaaaatttactcttgtgtttattttttttgtatactaaaatattgagattcttccccgcagtgtcctgaagccctcaatgttcgtatatctctttaaggtatcttatgtgtatgaaatatggctctaaaatgctagatttggccaacaacaacaacaacaaaatccccccacctttttttttttttgagacagagtttttcttttgctcttgttgcccacactggagtgcagtggcgcaatcccagctcactgcaacctccacctcccaggttcaagcgattctcctgcctcagcctcccaagtagctgggattacaggcatgcaccaccacgcccagctaattttttgtatttagtagagacagggtttcaccatgttggtcaggctggtcacaaactcctgacctcagacgatccacctgcctcggcctcccaaagtgctgggagtacaggcgtgagccaccatgccgggcccacaaaaatcaatttttagagctgttcagttcattatgtttagaagaacagataaattgtatacaacaataatatagctatatgttatagttattgtgtttttcaacaaaatagtttatttgaaggattggtatgttgttaacagatttcttaaatataatcatacttggattatgaactgtcagattaaaaataatattagtgcttgtatttttctgtgtgtgtgtgtgtgtgtgtgtgtgtgttatgttttcactaatcgaagaagcttgctggtatttctttcttggtccttggatacactcaggctttctttctaatacaactccctctatgcagatatactcaagatgagtcctccctatcttgtgtttaatacaaggtcatgtaatgcaatatatttagttaattatacctaacttttaaaaagtcctttacgtgaacctataattatatgtatttttatatgttactatgttctaaaggtgtttgatgtttaaagttcatttagaaatgttcttataagtagaattacttcaaccatctgtacagactagcaaaatattattctaagtgtctccttatgttttaacctgaactctctctctgctttaattgcaatagctatggcaaccaccccatcaatgacaaaaatcctagaaggatgtatgtataggaagttgaagtgttgagaagagaatggctcagagtcaagcgggaacaaggtaaaaacatcaaaaggttgtactggtgataatggccaggtgtgtgccattagtgcctccttgatattaaaaaaatatatggtggatcaactacatgttagtcaattccagcctagcaatcaagaggatattgaaagggaacttttcaacaagatagcaaataagttaagtgcatggaccatggactttctctccaatctacttgatatctaagcttcactaagtatccagatgccatcttgtgatgaaagaaaatgccattcttagtaagaggaaagacataattacaccacatatgttgcgatacactaaacacatttctttttttattacatgtaaatttaatttctcctaccttttccagctttgaatcattaaatcctgtgtaggtcagatgcagttaaaaacaaataggtctttactcaaccatgactttaaaattaaggattaatgtgtatatatggaaaaatgtttatctttaaattcacgttttgtagaaatgagcacacgcttactaataacaaaagttcatattaacatactaagaaggcttgaagaatataaaatacatttggagagactaaaatgtaaactttattgtgataagcctattgcaggaagaatgcgtgatacagatatgcataatgtgatgtaggggaagtattttaaaacaaaaagaaacaacttttgagataccaatggtgggtgtgagttgtgggagagatgggtaagtaatgcagagcaacaaaaatgtctaggaatgcacaagtaagcatgctggtttccatttcagattcaaacttcagagagagagggaagaaaaacatttaaatatatctggcataatccaagactatttacgacaagtgttctgtgtttctaataataaaacagacttcacctcggagtacctgcagaactgggaccccaatgaccagggagaatgaagaacaacttgttgaaggtatagagaaggcagcaaatcatacaagaaggtccatcccaaaccagagatagtatagataaatctctcatgttaactatggaaaaaataaaggaagatgacgtattttaatagaagggaaattgcgcttattgggagtaagaacactgaattgactgaatatcttaaagagagttaggaagtgaaattctcaacaggtgattattctttgaccaattttgtcttatctcttatccacattcttccctgctcttcccaatacatgtgtaagaatatccaagggcacacacataccataagcaggaatggtgtcctaaggaaagtcaatatagagagtaagaagtatatctgtcacaatgtgtacatgtatacatcctaaatatttgtacaattaatttacttctcttcatttccaacactcctagtctatgctatgaacatctcttacctaaaatgctacagatgtcccctaaatttttccataaatcagttttttcctctccaagctgtaagcagaaatgcatttttaaattgcatatatgaccgtgacacgtatctgtctcagtttatagaacaggtctctaacagggccagcagcttccagtcacttctgtcccttaccttttctccagtctcattttacatatttttttacatgctctctatattcctgtaattaaatattactttcccctcaatgcctttggactgcttctttcctccacattaaatactttttaccacttccctcagttcagttcattctcctccgtgtttagagctcagctcagatatccttttctcatggagacattctctggccaacccagactagatcattttcccttgctgtatactttcatacctccctctgtctttccttcataacactttggtaagtgtgtacaactgcatccttgtttttatttaatttcctctcactgccatgttctgtaaactcaatgcaagctgagtctgcctatttatttcactatgcgacacctaactcctaacaaagtattaaacaaaataggtgccaaaatatctgttaagccattgtgtgaatgtataaatgaataaagatatgaatacagatacactagtctaaacacgtttgcatggcacatacctatatgtgttccaaatagataacaaggagaatcacaattgatcattgccagaagaaaaatctggtaaaacttttactttccagatatttaaatagcattcatgttaaaatttttagttcacttttataatgcattgaaaatacttagggacattatttacttatcagaagtttattttactctttgaaaatatattgcttactggactattcacaatagcaaagacatggaatcaacctaagtgtccttcagtggggggactaaataaagaaaatgtggcatatatataccatggaatactacacagccataaaaaaacaaaattatgattttttttttttttttggcagcaacatagatgcagctggaggccattatcctaagtgaaataatgcaggaacagaaaaccaaatactgcttataagggagagctaaacattactcatagaaataaagatggcaacaatagacattggagactactagatggggaagggatggattaaaagggctgaaaaactaactcttgggtactacgctcacctcctgggttacagaatcattcttatcctaaaccttagcatacacaatatacccaggtaagaaacttgcacatgtacccccaaatctaaaataaaagttgaaaattaaaaatatatgcatattgctcattgagatagactacatattgagagattagctctatgaagataacatgaaccctaaattgtgtgattgagagaattctacacatttattggccttcattttagataacatgttaaataattcaataatgaacatttgactgtgcaacctcttcatataaatgtgcatattagtcaaggggctgtattattagcttaacaactaaagtctatttttttttttgcatgtgcaaagtccaatgtagaggtgtctggaagatctttcctaaatgtgactctgtcacctaagtggattgcattgtcatggaagccactatttcaagctgtagcctctaaaatctctacagccagggttgggactaatattcaacccttaaactatcattgcattgatcagtaatcaatcacctagttatgcctcacttcgatagagctaggagaggcagtttatggctgtatcagaaataggatgaaggtgcctgggcatggaggctcacgcctgtaatcctagcactttgtggggctgaggcagaaggattgcctgaagccaggatttcgagagcagccttggtaacatggtgagaccttgtgtctacaaaaagtaaaaataataaaatttaaaaaatacccagatgtgatggtgtgcgcctgtagtcctagctacttgagaagctgaagtgggaagatttcttgaacctaggagttcaaagctgcagtgagctatgaccatgccccttaaacagtgaaacagtgaaaaaaatagcataaaggaatatgtactgtaatatttaagtattggatttttagtaatgaaaagtttctaatggttaactgtgtttccccacaaagatacgtttaattcctaatgccatgtacctgtgaatgtaacaatatttggaaattaggtctttgcagatataattatttaagatgaggtcctaataatttgtggtaggtcccaattccatatgactgctattcttataagatgagaaaacagaaacacagaaaaaaggcttgaaaaaatacagacatagaaaggcagagactggagttgggctgctacagccaaggaatgcttggggctcccagccgttgggagagtcagggagatgctcccctacaggattagaaaatatatggtcctgctcacatattcattctggacttgtagcctccacaactacaactatgagacaacagatttatgttgttttaagccacccactttctggtactgtgttacggcagtcctctaagatgagaacaatatagaaagtcagtcatatccttccagaaattaacaagctggaatcacattttattcattggcctagtaaattcctttgccattctcagtatttctagaaaaatatcgggttgttgtgttttatttttattttttattttttgtctgataatgaaaaggataaaaaatcagctaaataacaggatttttgtcatttgaggatatcacttactaacaagagcttacatatttgaatggaccaacaggtaaataacaggtacctgtaggccatccgtattgtcaaactaagtgtaaattacaaaacatagaagacatacttaggattcaaacaataaagattcagagaagagcaattgcaatctctctcctatgcacagaaaactgagtgaagcattttatattttaatttgtgtttagtggtgatgacaagctcatcaaagaatggaacattgatgcctcagcattataggagacataatcttcatagccctaaatgctgcacaggcaggtacagaattgggcgcatgtctcatggtggccagcagcttgccttcatagaaaggatgctcgttgagcagaactccatgcactggttaccatgccagggaaggactccaactacatggaggatagcaaagctcatcccaaagccagccgacaggaagagaaatctaaacatgtctactcagtgcaacttcctatggcaattgccaaggaaaacatgatagaggcaagcactggattcaacaatgtgtttcctgaatagaaaagagacagagctagattagctacagtggcgtgcctcagtccaccatggctagtggctgcccttggaaatcaacacagggcaactggcttacatgtaccagaatagaaggactgcaatctgtcccctatgaagtctgaagtaccaaaatctgagggcatatctgagggccactgacacacatgcttggcctggataaaggaggagcacaccttgagtctgaaacgggaaaagatatccccacacgaggtgataagcccagcacaggctgtgtggactcttgttctcttgggatggaagtgtttcaggcccagtgcccattcctattcttatgtggctgagcagaaatcaaagactgcaaggacgagactacctagcccaacaatcataaacttcagttctgaacagaggctgcaagtccacccaatccacttttcctcaatttccttttctttgcctgactttttctttattatcattttgagtattccagaaacccattataagtcattacttcactgcagtcacaaggtccctaagggaagaacttgcccctccttttttgggcccctatgtgacacgtcagatctttagttcaggtttgtcaatactatttctccacttcttttataagctattaattcagtttccatgacaccaaactccttatcctatttcattgaccacatggttactgttctcattaattattgtgtcttttacttaatggctctctctctctctctctttaattttatcttctcactctacactcccttttttgataaactgtctattcctatggtatacttggccatcgtaattgtggtaatgtccagatttctatttctcatatcaccttcttccttgagtatggactcatgattctgcttcctactgggaagttctgacaacatctataatttacatgggtccatattgaactttttttcttacattcctttcccttaataacagcacttcttatctgcactactatgtacaaatttcatgataggaaatccaaggcagaattatcttggtgacactcatgggtgtaccactattaagattcttctgtcactcattttttgatcatgaatttatagtgactaaccagatatatagtacatgacataaaattgaatcaattatctaaaaaacaaaacaaaactaccagtggtaaatggatgattttcaaatatggcatttcaggctgttataagaaaacttttacacaaattaaattaatgatatttatctgagcaagaacaattgataaattaggccgcactctaaaacagaacagatgcagagagttctgctgaacagtgtgagcagtgggtttttagaggccaaacacagaagcaaattagaaaatcctctgattggctacaggtaggtgtctgacttatttgttggtgcaaagaggcatttcttttgcgggggcaagtctgatcagttgtttgcctgtgattggctgaagctcagttgtatgtaattggtagaaatctggctatttgttatgaaataatattctcctaagttagattttggtttatgtactaatttaggttgcagttcgttatatagcaactcaaagtacagggatagcctcagacattaactgaggtctcctattttttaatttaataatacaagaacagtcttccaagatccaaatacacattttaaaattctgtacatctataacttcaccacatcatatccaaattgtatcctacttttttgccttttatattaatatttataataaaatttgtataatattaagtataattatttcatttaatagtattcacttaatggtactcatgccactcatttgcccaagctaaatcttacagtctttccagttcttacaattttaaaaatctcctcgtattcaggaaatcatcaagaccgctagcaggagaactcccttacagacctagacctcccacctctagactcatacatgagagagagagaaagttttgcttttctcaagacacagttcttttgagtgcttcttttactttcagccaaacttagttccatttaataggttttaatatatacttaaacaaattattatagtaaaagtaatgaagtaaaattatttcaacttacaacaatataaaataaacgtttcgtagggaaatgaacagaactacttaaaacttcagaacacaaggctattttactagattttgttcagtttaatagaagcgtgttccacatcacagacaagattccagtgtttagttgcgatactggccagaaggaggatcccttctgagatgtgatcactgtcaagaaagacttaacacatgagagagatctgcaattccattgccaatcattcaaagttccttgaagatcaacaatttcatcgagaaagacttgttctttgaaatttagaatatccagaacttttcttacataatagcctataaacttcagtataaaacaataatcattaatagtcactggtttatttctttaaaaatcttgtcaaacaattttaaaattcagcggaatcgctccttaatgcaattaagatgtttagcagctttaagtagttatcttaacatttctgtatctccagggtcaaagtgtcatattcatggctagattttgtagcaaaagcagcagtttatctatgtgaaacacctcttattggttcagcttatctcaatatgttatttctatgccatggtgatatttgctatgaaagcactgatatattttagaagatattctccattcatatgggtccttctagtttggcagagctaaatggacttcgttatttatatttcatctgacaaaatggaaaagtttaggtgaactgacatgaccagattttgtttgtagtacactattttgatttgaattattatagataatttacatttctaaatgcatctctaattccaaaatgaagaactactgtacttcagcaatgatactgtttttctggctccagatcattttaaagcaggtttaataaggaccctgagaattatctcaactgtgataactgctgtgatatttgcaataaaatgttataaaataactacttaatacttactgtattagtcaattcttacatggctataaagaacaacctgagactggataatttatgaaaaaaagaggtttaattgactcacagttccatggtctgtacaggaagcatggctggtaagcctcaggaaacttacaaacaagacagaaagtgaaggggaagaaagcacattttaccatggtggagcaggggatagagagagcaaagggggaagtgctacacacttttaaatgaccagaccttgagagaacttattatcacgagaacaacatggcggaaatccgcccacgtgatccaatcactttccaccaaatccctcctccaacattggggcttacaattcaacatgagatttgggtgccgacacagagccagaccatatcgcttgcaatgtttccccctgttgtgctacattttgtttatcaggactattgcaattttagacttggctttaacaatacattaaatttaattcagttacttgtaccttcaagagatttttcaggctggatagctctgatcctgaagatgagaccagatttaaattaaaaaaaaaaaaagttaactttcattaccaagctgcgaaaatctaaattttaaatgttaattttttatcaaatttgttaattttatttcatttaaagctgaaaattttaaaatgcaaaaaataggttctattgtcattgtgttttgatctgggttttataaacctatctcattatatttattcattcagaaaatatttattgagtgtctcagttctaggtgctatagatttattaataaactcaacagacacaaatatttggcagttttgttcacagtcaccaataatattcatcatttcaatatttagctgttaaaaaaattaatcactaatatagtatgcattccaaaatgaaagaggagagaggaagggaacataactaaataccaatctatactttctatatttatacaaattccatacactaaacaattattagtaattagaggtaacattttaacctttaatttaaaataatgtaaaaattcataatgaagtctagtacacgataattctcattaataatttaaataatttataccaagtagttatagtggttgattcaatgaaagacttattggaattcatgcctataatttataagatctgccaccctaccagccttactgtttttctcattggtaatattcatgaagtcactggtaattttacattttaaaatatgcagtatgaattgcatatatagtacttcttaaatgtcaacacatttatcttaaatcatttatcgaagtatgagaagtacctatcatattttggtaaataatacctttaggtttttcctagttcttggctccagactaaccatcttgacctgtcattctagtttttacttctgagacattctatagtctgtgtctgatattctctactatttcctcatttgtccttgcattcagattgccttttctgactcccagcttccacggagagattaactctgttggctgaagccctattcccaattccttggctagaccctgggtccttcatgttagaaaacctggctttactactactactactactactactactactactgctgctgctgctgctgctgctgctgctgctgctgctgctgctgcattttttaaaaatatattatcttattttactatttgatgttataattgttatatatttttccacacttcctcatactgcttatctcttacttaagaatttatgaataaagaattgatttttcaatacatccttccaaaaattatctgatgttgagttagttgctctctcttgtgcattctcagtcctcacaagcctttctcaaacacaatgtttatcaaagaaaattgtagcaaccaatatacttagtggaatttctcacagagtttgagtgtaggaaacagtattcactgtatattagtcattttgctcccaatagaaggtgcataacataaattatttaagtggatgaatgctttattttcctttataaaggtaccttcttgcttcactgacatttctatacaactattcttgtaagcaaggaatgaattcctagctctgttttttaatcacgatttttgaaagttttggatattttcaaggtttatgatgttttaatgtagacatattatagattataatctgctggaacctaaacccatatagttctcccatacaccaaaaaataaaaaataacacactctaacttttaaatttagtagctagtaattagggctacaactcttcataaaaaattctctgactgaatcaagaaaaagtcagagcctaattattactctgcactaaaagtaggagcagtggtagaaactgatggagttagtatattacaagtacatactgagtcaaactatgctaagtgctttgaatttattattttcatgtggaaattataataaaatatgaccaaagtgttcctctgtcaacaataagttatttatttttgtattttctgaccatcttaaaaagttactggagtaagtattcgataaatttgaagaatttatttttattcatgtaataacaatgtccactctacttcttcactaggtgagcctatctgtatcttaaatactttcattctgtatatgcactgagttattgtaactaataatgccaaaatttagggcatgtgttttaaacaatgtgtagagttactaatttcacttcccctagaatttgcttaccataacacacacacacacaaaaaaaaaaaaacggagaagaaatgttaaagtcataaataaaagtaattcaatggttcatagctatgataacactcatagaatgtcttcacccaattatgtataactcaggaatcctctgaatgtgtattcctctttaggcactttatctcttctgcagatgaactttctttgtttttctatgcatgtggtgaaaaatggttttatatcattttcctgatttaatgccccctaaccctgttttagtaatctcaaattcaaattatttgaaagaaaaaaaaaagacactgagtgttccagcttattctatgaactggtctttgtgggccaggtttctacttgagatcaaataagctatggtcagtagagacaaggctatctacgatggacatagttgtagaggtccactcctgtatgtgttgggattagtgattacagtggataaactgagtctcattcctaccatagttgaaccatttacttgtagtctgaacaataaaagactatatttagtttttatatttagtgatgagtttgaagccttgataagccttctcaggcactgtattttcttgctgtacatcctcaaggcttccctagttcttacagtaattttatgtgaatgggaaaaagttgatccttcctcaagtttctttgctcttatctgttaagactatcataacaaatacctctttcgtcatcgatatattttactgctatctcctggaaatatgttgtaataaatattaaatctatagtgtctgtagtttgaataacacctccttacatattgcacagtgttcaactcacccaactgcatgtggcaacccctacagattcttaccatatattttttgtttgagtggacatttggcataatgaaagtatttataactgcaaaatattttaatctttcaaatatatttttggaacatcattattttatgtgtatggaacttattatttgcagaatacaaagaggatatagtatcccctgggaaaaagaaaacttataatgccttaaccaatctgtaagaaatttatatatacaaatatgtgtgtatatatacatatgtgtgtgtgtacgtatatatataaccatttcactctcttaactttaaagtgttgttttgttactttttgccccactcaaactccaaaaaagccaggaaactgattataacatttttattcattcatcaaaatggcaaaaacagtat

SEQ ID NO: 71 - DNA, 4367 bp, Homo sapiens
gacgccatactggacgccaagtgggaggaacttcaaggctgtcccctgcgggcctcccgctctgcttctgcgaaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaaaaaa

SEQ ID NO: 72 - DNA, 4411 bp, Homo sapiens
acttccggtggagggccgcctctgagcgggcggcgggccgacggcgagcgcgggcggcggcggtgacggaggcgccgctgccagggggcgtgcggcagcgcggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagagggtgttagtggcttcatcagttgtagcaggggaatcccagaaacctgaactcaaggcttggcagggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagatcagagttgactgcaataatgaaaggagtgtccacactaaaacattacagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttttattaaaaagttgcacttatgaaaaagcaaaaaatt

SEQ ID NO: 73 - DNA, 3819 bp, Homo sapiens
atggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggaatcgcagcatctgaccccaggattcaccttacaaaagtggaatgacccaaccaccagagcttctacaaagatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtag

SEQ ID NO: 74 - DNA, 1142 bp, Homo sapiens
agggcggagcgggcggcagacccggagcagcatgtggactctcgggcgccgcgcagtagccggcctcctggcgtcacccagcccggcccaggcccagaccctcacccgggtcccgcggccggcagagttggccccactctgcggccgccgtggcctgcgcaccgacatcgatgcgacctgcacgccccgccgcgcaagttcgaaccaacgtggcctcaaccagatttggaatgtcaaaaagcagagtgtctatttgatgaatttgaggaaatctggaactttgggccacccaggctctctagatgagaccacctatgaaagactagcagaggaaacgctggactctttagcagagttttttgaagaccttgcagacaagccatacacgtttgaggactatgatgtctcctttgggagtggtgtcttaactgtcaaactgggtggagatctaggaacctatgtgatcaacaagcagacgccaaacaagcaaatctggctatcttctccatccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctacaaatgtaaaaaaaaaaaaaaaa

SEQ ID NO: 75 - DNA, 13481 bp, Homo sapiens
gctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctaaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgcggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatca

SEQ ID NO: 76 - DNA, 2507 bp, Homo sapiens
ccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggagggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacgccgctgcatcccgacgcctctccggcggtggacggcagcccggccgtgtcccgcgggggcttcgtgctcgtggcccacagtgactccgagatcctcaagagcaagaagaaggggctgtttcggcgctcgctgctgagcgggctgaagctgcgcaagtcggagtccaagagcagcctggccagccaacgcagcaagcagagctcctttcgcagcgaggcgggcatgagcaccgtcagctccacagccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgtcatggctacggctgcatgaccttcccggacggcaccaaggaggagggcaagtacaagcagaacatcctcgtcggcggcaagcgcaagaacctcatccccctgcgggccagcaagatccgcgagaaggtggaccgcgccgttgaggccgctgagcgggccgccaccatcgccaagcagaaggctgagatcgcggcttccaggacctcccactctcgggcaaaggccgaggcagccctcacagcagctcagaaagcccaggaggaggcgcggatcgccaggatcactgccaaagagttctccccttccttccagcaccgggaaaacgggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacgggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaagggaaagaccgcaact

SEQ ID NO: 77 - DNA, 2726 bp, Homo sapiens
ggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggagacactgtcggacattcgggaaggtgcgccgctaggggtccacctgccttttgtgggctactcctactcctgcatggccctcagggacagtgaggtcccaggccccacacccatggaagtggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggccagcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgccgccttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaa

SEQ ID NO: 78 - DNA, 3921 bp, Homo sapiens
gccacgtcggcgtcctcccgcttctcagccatccccgggcatctgcagcggaggccgctgtcaccgaggagacctggagctgtggcctatgatttcctaggacttcactctcccaactttagagggtagaacaccaccactccccatccccgctctaaaacactgcagaaaatgaccaagtacaagggacccgtgacattaagggatgttgctgtggaattctccaaagcagaatggaagctcctgacccctgctcagaagtccctttacaaaaatgtaatgctggagaccttcagtaacctgttctctgtgggttatcgtgtggttaagccaagtgtgattgcaaagttgaagaaaggaaaagagccatggccattagaagaatttttccgtaagagccgtggtgataagcggcggaccgctcacgaccccagagccaaacatcaggagcaacaggctggaaatgcaaggaaaggagaacttacaaagcatcagaaaactcccacccggcatgaaagctacgactgtagcgaatgtggaaaatctttctgccagaagtcttccctactggcgcaccaggaaacacacaccaagaagtcctataaatgtgagaaatgtggacaagctttctataagaacgaagacctcacaatccatcagaaagtccataccagagataaaacatacccatgtaaagaatgtaacaaaattttctatcacctgtcgtctctcactagacatctgaggatccacgctggggagaaaccctacgaatgtagccagtgtgataaatccttctatcagaagccacacctcacagagcaccagaaaacacacacaggggagaagccatttgagtgtaaggagtgtgggaagttcttctatgtgaaggcatacctcctggtgcaccagaaaacacacacaggcgagaagccttttcagtgtaaggaatgtgggaagttcttttcacaaaaatcacacctcacagtacatcagagaacacacacaggggagaaaccctacaaatgtaaggagtgcgggaaactcttctctaggaattcacacctcaaaacccatcagagaacccacacaggggagaaaccctacaaatgtaaggagtgcggaaactgcttctaccagaagtcagccctcaccgtgcaccagcgaactcacaccggggagaaacctttcgaatgcagtaagtgtgggaaacacttttactataagtcagatctcaccaaacacgagagaaagcatacaggggagaagccgtacgaatgtgcagagtgtggcaaatctttctctgtgaactcagtccttagattacacgaaaggactcacacgggagagaagccatacgagtgtgagatatgtgggaagtccttctctcagaagtcccattttgtcatccatcagagaaaacacacaggggagaagccctatgagtgccaggagtgtggggaaggctttatccagaagtcacaactcacatcacatcagaagacacactccaagaagggaaaggctaacaagtagcgcaagttcagaacccctgcaggaattcaccctttggctgtaatacacacagagggagaaccttctaaatatggaggaaaaatgtcagccatgttccccccgccccccgagaattatcagcaaatgtgcagaaagaaattcttcgatgttattaggtagaccttgacaatagggtcaactttcataaatatcaggtggcagaagacattttgcaagctacaaaatgtgaaagaaacttttctttgaaagaaacttttctttcagaagtcacactggtgccatatagaaataacacagggcagaaatccagtaagtaagtggatttccagaagtttctctcatagcatctagcattacacatgcagagttcacagtgaggaactccggtgggtatcaggcactcagaagtcttcttacaaggttgcactcatcttaaaaagatggaagggcattcatgcatagattgcaaacagataggagagccttatcaggaacacgcccatcgtgaaatgttaattgcatgagtactttaatcatccctatgtacgtattttaaatatttgaaccgccttcaacaaaatgccctgaaggcagcggtcacactcttagtcccaatgccagttccaaggttgtttttacttcctaaagaaacatacaatataaacagaaaccaactaatatcacatatatcaaaggtagtaaaagagcaaaacacaggggctggagagatggctcagcagttaagagcactgactgctcttccagaggtcctgagttcaattcccagtaaccacatggtggctcacaaccatctgtaatgggatctgatgctcttttctgatgtgtctgaagacagctacagtgtactcatatacatgaaataaatacataaatctttttttaaaaaaagagcaaaaaacaatcagaaaacatcattaaacaaataagtcttttaataagtaggatctaggggtgtgtgtgtgtgtgtgtgtgtttacctataaaaaaaaatctatctaaaaaactgtgtgtcttgctcttggagcccattgtggttgttcctgagctcagtagctgtgtaagaacacatgtcacattgtatcaacagtgactcccaccggtggcattgttcctgtaacatatattggtgtatactttaaatgcacagtgtgtctttttgtccatctctgggcacttacaaatgggttcagacattgttactaaatggacccttcaaaagaaacactgtttttgtaacgttttcggctaaactgtgatgggctgaacttcagcttggacatgcatttgagcggtcagagctgtttctaaagcagcagtatttccttattttattgtagatgtagcagtggcatctgtgtttgtattgtgtatgaaaaatacctcatgactttcccttcctattctgggtagcagaggcaacatgaccagtggctcaaagtgagattctaggctcttactacctttgttgacccagatcccagcatggacataccatgtaacttcactgtgcctcaccttcttcctctgtaagagaaatgacagtaacatcctagaattgccctgaggttgaaatacgttgccattttgaagcactcagaacagtgtctgtaaaacataagaactcgacattagatagtattcccattaatttgtatttcccgaatcacatggtgaaaaggttggcaacccagaatttatctcccatcttattcctgttagtgccttgatttgatttggctgtgtatctccccaccgtggctcaggagcagaccctaagtaggcaaggccaggggttggtgaaccgcagcccatcggccagatccacagcccgttttgtagcctgtaagctgaaattagttttatattactcaatgattgcaaaaattaagtattttgtgacacatgaaggttgtacaaaacaaaagttccatatatctaactgaagcactttgagaacactaatacaaacccgttcgctacattctgcctttgctgccttcgaactgtgctagcgaggcagacctaagatgttgctgactcagcactttaccgcatcggtttctgttactcagggctgcacacgctgcagccggtcctgagcccttcttctaaacgttctgtttaccaaatgtgatgcctcagtgtatgggtgggtaatttttgtgcagtatatttattttgtgcattgtatttatatgtgggaaaagcctaggctttgaagtatttttttcccaaagaaatgtgggtttttttttttacacttactgaattgttacgttaaagcatatctcctgatggaatgtaataaatatatgaaataaacattgtctcaattaaatggaattaaattttcaattaatcttt

SEQ ID NO: 79 - DNA, 3569 bp, Homo sapiens
taataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaaacaagcaaacaaaaaaaaaa

SEQ ID NO: 80 - DNA, 10636 bp, Homo sapiens
gaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagttttacctcacaaaaactactacaagcaccaagctccctgatggaaaggagcatcgtgcatcaagtcaccagggtggtccattcaagctgcagatttgtttgtcatccttgtacagcaatctcctcctccactgccactacagggaagtgcatcacatgtcagcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 81 - DNA, 1952 bp, Homo sapiens
agagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgtttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaaaaaaaaaaaaaaaaaaaa

SEQ ID NO: 82 - DNA, 2300 bp, Homo sapiens
ggccaggcaagcctgaatcctgtccctgccatctcgccactgcagctcgggtccagaaaggcaccattttgtcgcggctgcccgctctcccagggggaggagggatcttttttgcattttggagcggctgccaaggaggggaacctgttgggcatctccccagacccgcttgtgagcgcctccggggcgggcgggcgggaccagacccctcggggcacggcgtatcttggcacccggaggcagcggaggcaggcgcagcatcctcgctgggaactggagctggagtgagcgcaccgcgcgggaggagccgccgcagcctcgcagaacccgagtggaggaggtgacagctccattgccgggtttttattttttttctctccgcctccccgtctcctcctcaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttagacaaa

SEQ ID NO: 83 - DNA, 1876 bp, Homo sapiens
cgcggccgcggttcgctgtggcgggcgcctgggccgccggctgtttaacttcgcttccgctggcccatagtgatctttgcagtgacccagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcagcaacagcaacagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaacatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacggaatatatgtgttaatgaaaatgaatggctgtacatatttttttctttcttcagagtactctgtacaataaatgcagtttataaaagtgttaaaaaaaaaaaaaaaaaaaaaa

SEQ ID NO: 84 - DNA, 4712 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcctccttctccccctcgccagcccgggcgcccctccggccgcgccaacccgcgcctccccgctcggcgcccgcgcgtccccgccgcgttccggcgtctccttggcgcgcccggctcccggctgtccccgcccggcgtgcgagccggtgtatgggcccctcaccatgtcgctgaagccccagcagcagcagcagcagcagcagcagcagcagcagcagcaacagcagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaaaaaaaa

SEQ ID NO: 85 - DNA, 1211 bp, Homo sapiens
ggggcggagctggagggggtggttcggcgtgggggccgttggctccagacaaataaacatggagtccatcttccacgagaaacagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaataaaaaaa

SEQ ID NO: 86 - DNA, 6792 bp, Homo sapiens
atggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaatccgaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccaccccccgccccccgacaaggaccgctatgcccaggaacggccggaccacggccgggcacgggctcgggaccagcgctggtcccgctcgcccagcgagggccgagagcacatggcgcaccggcagtag

SEQ ID NO: 87 - DNA, 3969 bp, Homo sapiens
cgttgctgtcgaaagggtgaaagagaaacttggcgacctcccggaggagttcgcgaagcgaccaggagcgtgttgccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccagatctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccgtgaacaatgtccacatgaaacacacaggcaccatcccaggggcacaaggactgatgaacagttccctccttcatcagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagttagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtatcgacagcaacggaattcgagctccgtc

SEQ ID NO: 88 - DNA, 1472 bp, Homo sapiens
atccttcacctgttgcctggctagagttgtctggctccactttgagctcttgcagaaccagccctttttcgtgtggtccaggaaagtccatgcctggcaccacctcctcctctagtgactccacgtagaagagagtcctggctggctgctgagtgccctgcccaggagccccttgctgcagcctcgtggcaactggaagcagggtgccattcagcggattgaaggaagaggaggaagaggacggggaggacgatgaagaggaagaggaggaaggcttcttccagaaagtgctcacaccgcttctctcttggcttttgagcaggcgactctggctgggtccccagtgctcaaagctgccactgccgtcctgttgcaggcagcctccccccgccgggccgccggtggaaggagacgggtggctgaagagtttccagcggagtcgcagaatgtgcttcacatcgaagtcttttcgcccagagcctgacatgctttacgcacagaaggcaaaaggctggcagctcacgcagggttctggaggctgggaagttcaagaccaatgcacgagaatttggtctaaagagaatcttcttgctctgaacacacatagtagaaggcagaagggcaagagagagaacaaagtctgtgtctccacatggcagaagagcagaggagacagaacctactcctctatggcaaccaccccatcaatgacaaaaatcctagaaggatgtatgtataggaagttgaagtgttgagaagagaatggctcagagtcaagcgggaacaagattcaaacttcagagagagagggaagaaaaacatttaaatatatctggcataatccaagactatttacgacaagtgttctgtgtttctaataataaaacagacttcacctcggagtacctgcagaactgggaccccaatgaccagggagaatgaagaacaacttgtttgaagattgccttttctgactcccagcttccacggagagattaactctgttggctgaagccctatcccaattccttggctagaccctgggtccttcatgttagaaaacctggctttactactactactactactactactactactactactgctactgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgcattttttaaaaatatattatcttattttactatttgatgttataattgttatatatttttccatacttcctcatactgcttatctcttacttaagaatttatgaataaagaattgatttttca

SEQ ID NO: 89 - DNA, 21 bp, Artificial Sequence
  Primer
aaagcaaggtctccccacaag

SEQ ID NO: 90 - DNA, 24 bp, Artificial Sequence
  Primer
tgaagggtctgtgctagatcaaaa

SEQ ID NO: 91 - DNA, 19 bp, Artificial Sequence
  Probe
tgccacatcgccaccccgt

SEQ ID NO: 92 - DNA, 20 bp, Artificial Sequence
  Synthetic oligonucleotide
tgcctttaggattctagaca

SEQ ID NO: 93 - DNA, 20 bp, Artificial Sequence
  Synthetic oligonucleotide
taattgccaatatttgcccc

SEQ ID NO: 94 - DNA, 20 bp, Artificial Sequence
  Synthetic oligonucleotide
gggagttacttgccaacttg

SEQ ID NO: 95 - DNA, 20 bp, Artificial Sequence
  Synthetic oligonucleotide
ttgcagttaaacaatggaaa

SEQ ID NO: 96 - DNA, 20 bp, Artificial Sequence
  Synthetic oligonucleotide
ccaggctggttatgactcag

SEQ ID NO: 97 - DNA, 20 bp, Artificial Sequence
  Synthetic oligonucleotide
ttatcaattcaccaaggagc

SEQ ID NO: 98 - DNA, 20 bp, Artificial Sequence
  Synthetic oligonucleotide
atggaggtatgacatataat

SEQ ID NO: 99 - DNA, 20 bp, Artificial Sequence
  Synthetic oligonucleotide
ggcatatgcagataatgttc

SEQ ID NO: 100 - DNA, 20 bp, Artificial Sequence
  Synthetic oligonucleotide
acattggcacacagcacagc

SEQ ID NO: 101 - DNA, 20 bp, Artificial Sequence
  Synthetic oligonucleotide
aggcaaacgaaacattggca

SEQ ID NO: 102 - DNA, 20 bp, Artificial Sequence
  Synthetic oligonucleotide
ctaacatgcaatactgcaga

SEQ ID NO: 103 - DNA, 20 bp, Artificial Sequence
  Synthetic oligonucleotide
aagcccacaggaacaagtcc

SEQ ID NO: 104 - DNA, 20 bp, Artificial Sequence
  Synthetic oligonucleotide
ggtcaatagtgtaaaacatt

SEQ ID NO: 105 - DNA, 20 bp, Artificial Sequence
  Synthetic oligonucleotide
ttcatgaaggatgaaatgcc

SEQ ID NO: 106 - DNA, 20 bp, Artificial Sequence
  Synthetic oligonucleotide
caatgcattctaatagcagc

SEQ ID NO: 107 - DNA, 20 bp, Artificial Sequence
  Synthetic oligonucleotide
aacatttccacttgccagtt

SEQ ID NO: 108 - DNA, 20 bp, Artificial Sequence
  Synthetic oligonucleotide
ggttcccaatccccacattt

SEQ ID NO: 109 - DNA, 20 bp, Artificial Sequence
  Synthetic oligonucleotide
taataaaaatcaggtgaggc

SEQ ID NO: 110 - DNA, 20 bp, Artificial Sequence
  Synthetic oligonucleotide
tcccacccagcattacagtt

SEQ ID NO: 111 - DNA, 25 bp, Artificial Sequence
  Primer
gaattgcgtcatttaaagcctagtt

SEQ ID NO: 112 - DNA, 25 bp, Artificial Sequence
  Primer
tcatcctaccactcccaattaatct

SEQ ID NO: 113 - DNA, 30 bp, Artificial Sequence
  Probe
acgcatttactaaacgcagacgaaaatgga

SEQ ID NO: 114 - DNA, 17 bp, Artificial Sequence
  Primer
aggcgttgtgcgtagag

SEQ ID NO: 115 - DNA, 29 bp, Artificial Sequence
  Primer
aaaggttaccataagtaagttccagaaaa

SEQ ID NO: 116 - DNA, 28 bp, Artificial Sequence
  Probe
agtggttggtaaaaatccgtgaggtcgg

SEQ ID NO: 117 - DNA, 20 bp, Artificial Sequence
  Synthetic oligonucleotide
gggtcagctgccaatgctag

SEQ ID NO: 118 - DNA, 20 bp, Artificial Sequence
  Synthetic oligonucleotide
cggtgcaaggcttaggaatt

SEQ ID NO: 119 - DNA, 20 bp, Artificial Sequence
  Synthetic oligonucleotide
ttaccctagatgtttagcca

SEQ ID NO: 120 - DNA, 20 bp, Artificial Sequence
  Synthetic oligonucleotide
gaaaatggcatgtctgcttc

SEQ ID NO: 121 - DNA, 20 bp, Artificial Sequence
  Synthetic oligonucleotide
taagatgctagcttggccaa

SEQ ID NO: 122 - DNA, 20 bp, Artificial Sequence
  Synthetic oligonucleotide
aaattgatggccttttctgg

SEQ ID NO: 123 - DNA, 20 bp, Artificial Sequence
  Synthetic oligonucleotide
atatgcagcttttcatcagt

SEQ ID NO: 124 - DNA, 20 bp, Artificial Sequence
  Synthetic oligonucleotide
acaagtacattggagcacat

SEQ ID NO: 125 - DNA, 7003 bp, Mus musculus
aggcattcaggcagcgagagcagagcagcgtagagcagcacagctgagctcgtgaggcaggagactcagcccgaggaaatcgcagataagtttttaattaaaaagattgagcagtaaaaagaattagaactctaaacttaagctaatagagtagcttatcgaaatattacttagtcttaataatctaagaagatcttaagagataacatgaaggcttatttaaacagtttgaaaaaggaaatgaggagaaaagtatttgtactgtataatggaggctgaccagagcagtttaggagattgtaaagggaggttttgtgaagttctaaaaggttctagtttgaaggtcggccttgtagattaaaacgaaggttacctaaatagaatctaagtggcatttaaaacagtaaagttgtagagaatagtttgaaaatgaggtgtagttttaaaagattgagaaaagtaggttaagttgacggccgttataaaaatccttcgactggcgcatgtacgtttgaaggcatgagttggaaacagggaagatggaagtgttaggctagccgggcgatggtggcgcacgcctttaatcctagcacttgggaggcagaggcaggcggatttctgagttcgaggccagcctggtctacagagtgagttccaggacagccagggctacacagagaaaccctgtcttgaaaaaacaaaaaggttaggctagtatttggagaaagaagattagaaaatggaagtgaaagacgaagaagacatacaggaaggtgaagaaaaagctgttagagaagataggaaaatagaagacaaagcatctttagaagacagaaaaggtacttaaaggcacaggtagtaggaagccgaagaatagaagatagaaagaagcaagatagaaaaacaaaatggaagttaagacaactttggatgccagcattcaagataggcaaagaagataagattgagaccaaaaggttggataagatataaagtcagaaggaaattatctctaaagccataagttcaaatttctgatggagcgagcagtttagaagagtctttagacagccacatacaagattgaagctagcaatcaaagctactaggactgaagtaaaaagttaaggcagaatgcctttgaagagttagaagaatattaaaagccttaacttgtagcttaattttgcttgatgacaaaaggacttttgataacagtttcaagattgtcagcattttgcattggacttgagctgaggtgcttttaaaatcctaacgactagcattggcagctgacccaggtctacacagaagtgcattcagtgaactaggaagacaggagcggcagacaggagtcccgaagccagtttggtgaagctaggaaggactgaggagccagcagcagcagtgcatggtgaagatagcccaggaaagagtgcggttcggtggaggaagctaggaagaaggagccatacggatgtggtggtgaagctgggaaagggttccaggatggtggagcgagagcgagttggtgatgaagctagctggcggcttggcttgtcaactgcgcggaggaggcgagcaggcattgtggagaggatagatagcggctcctagaccagcatgccagtgtgcaagaaaggctgcagggagagcatgcggtgcggtaacattccttgaggtcggcaacatggtggtggttttctgtaacttggatggtaacttgtttactttgtcttaatagttatgggggagttgtaggcttctgtgtaaagagatatatctggggctgtatgtaggcctttgcgggtgttgtaggtttttctttttcagggttatgtcctcttgcatcttgtcagaagcttttgagggctgactgccaaggcccagaaagaagaatggtagatggcaagttgtctttaaccgctcagaggggaatgaatggtagagccagcacaacctcccagttttgtaagacgttgtagtttgaacagatgacctaccacaagcctcactcctgtgtaggggaggtaattgggcaaagtgcttttgggggaatgggggcaaaatatattttgagttcttttccccttaggtctgtctagaatcctaaaggcagatgactcaagggaaccagaaaaaaggaaatccactctcaggataagcagagctcgccaggtttacagtttgtaggaagtagaggatggatgctagctttcacactgagtgtggaggagctggccatggcggaattgctggtagtttactctttccccctcccttaatgagatttgtaaaatcctaaacacttttacttgaaatatttgggagtggtcttaacagggaggagtgggtgggggaaacgttttttttctaagattttccacagatgctatagttgtgttgacacactgggttagagaaggcgtgtactgctatgccgttggcacgacaccttcagggactggagctgccttttgtccttggaagagttttcccagttgccgctgaagtcagcacagtgcggctttggttcacagtcacctcaggagaacctcaggagcttggctaggccagaggttgaagttaagttttacagcaccgtgatttaaaatatttcattaaaggggaggggtaaaacttagttggctgtggccttgtgtttgggtgggtgggggtgttaggtaattgtttagtttatgatttcagataatcataccagagaacttaaatatttggaaaaacaggaaatctcagctttcaagttggcaagtaactcccaatccagtttttgcttcttttttcctttttctttttttgaggcgggcagctaaggaaggttggttcctctgccggtccctcgaaagcgtagggcttgggggttggtctggtccactgggatgatgtgatgctacagtggggactcttctgaagctgttggatgaatatagattgtagtgtgtggttctcttttgaaatttttttcaggtgacttaatgtatcttaataactactataggaacaaaggaagtggctttaatgaccctgaaggaatttcttctggtgatagcttttatattatcaagtaagagatactatctcagttttgtataagcaagtctttttcctagtgtaggagaaatgattttccttgtgactaaacaagacgtaaaggtatgctttttttcttcttgtgcattgtatacttgtgtttatttgtaacttataatttaagaattatgataattcagcctgaatgtcttttagagggtgggcttttgttgatgagggaggggaaacctttttttttctgtagacctttttcagataacaccatctgagtcataaccagcctggcagtgtgatgacgtagatgcagagggagcagctccttggtgaatgagtgataagtaaaggcagaaaaaataatgtcatgtctccatggggaatgagcatgagccagagattgttcctactgatgaaaagctgcatatgcaaaaatttaagcaaatgaaagcaaccagtataaagttatggcaatacctttaaaagttatggcttatctaccaagctttatccacaaaagtaaagaattgatgaaaaacagtgaagatcaaatgttcatctcaaaactgcttttacaaaagcagaatagaaatgaagtgaaaatgctgcattaagcctggagtaaaaagaagctgagcttgttgagatgagtgggatcgagcggctgcgaggcggtgcagtgtgccaatgtttcgtttgcctcagacaggtttctcttcataagcagaagagttgcttcattccatctcggagcaggaaacagcagactgctgttgacagataagtgtaacttggatctgcagtattgcatgttagggatagataagtgccttttttctctttttccaaaaagacctgtagagctgttgaatgtttgcagctggcccctcttaggcagttcagaattttgagtagttttcccatccagcctcttaaaaattcctaagccttgcaccgatgggctttcatgatgggatagctaataggcttttgcatcgtaaacttcaacacaaaagcctacatgattaatgcctactttaattacattgcttacaagattaaggaatctttatcttgaagaccccatgaaagggatcattatgtgctgaaaattagatgttcatattgctaaaatttaaatgtgctccaatgtacttgtgcttaaaatcattaaattatacaaattaataaaatacttcactagagaatgtatgtatttagaaggctgtctccttatttaaataaagtcttgtttgttgtctgtagttagtgtgggcaattttggggggatgttcttctctaatcttttcagaaacttgacttcgaacacttaagtggaccagatcaggatttgagccagaagaccgaaattaactttaaggcaggaaagacaaattttattctccatgcagtgatgagcatttaataattgcaggcctggcatagaggccgtctaactaaggactaagtaccttaggcaggtgggagatgatggtcagagtaaaaggtaactacatattttgtttccagaaagtcaggggtctaatttgaccatggctaaacatctagggtaagacacttttcccccacatttccaaatatgcatgttgagtttaaatgcttacgatcatctcatccactttagccttttgtcacctcacttgagccacgagtggggtcaggcatgtgggtttaaagagttttcctttgcagagcctcatttcatccttcatggagctgctcaggactttgcatataagcgcttgcctctgtcttctgttctgctagtgagtgtgtgatgtgagaccttgcagtgagtttgtttttcctggaatgtggagggagggggggatggggcttacttgttctagctttttttttacagaccacacagaatgcaggtgtcttgacttcaggtcatgtctgttctttggcaagtaatatgtgcagtactgttccaatctgctgctattagaatgcattgtgacgcgactggagtatgattaaagaaagttgtgtttccccaagtgtttggagtagtggttgttggaggaaaagccatgagtaacaggctgagtgttgaggaaatggctctctgcagctataagtaacccgtgtttgtgattggagccgagtccctttgctgtgctgccttaggtaaatgtttttgttcatttctggtgaggggggttgggagcactgaagcctttagtctcttccagattcaacttaaaatctgacaagaaataaatcagacaagcaacattcttgaagaaattttaactggcaagtggaaatgttttgaacagttccgtggtctttagtgcattatctttgtgtaggtgttctctctcccctcccttggtcttaattcttacatgcaggaacattgacaacagcagacatctatctattcaaggggccagagaatccagacccagtaaggaaaaatagcccatttactttaaatcgataagtgaagcagacatgccattttcagtgtggggattgggaagccctagttctttcagatgtacttcagactgtagaaggagcttccagttgaattgaaattcaccagtggacaaaatgaggacaacaggtgaacgagccttttcttgtttaagattagctactggtaatctagtgttgaatcctctccagcttcatgctggagcagctagcatgtgatgtaatgttggccttggggtggaggggtgaggtgggcgctaagcctttttttaagatttttcaggtacccctcactaaaggcactgaaggcttaatgtaggacagcggagccttcctgtgtggcaagaatcaagcaagcagtattgtatcgagaccaaagtggtatcatggtcggttttgattagcagtggggactaccctaccgtaacaccttgttggaattgaagcatccaaagaaaatacttgagaggccctgggcttgttttaacatctggaaaaaaggctgtttttatagcagcggttaccagcccaaacctcaagttgtgcttgcaggggagggaaaagggggaaagcgggcaaccagtttccccagcttttccagaatcctgttacaaggtctccccacaagtgatttctctgccacatcgccaccatgggcctttggcctaatcacagacccttcacccctcaccttgatgcagccagtagctggatccttgaggtcacgttgcatatcggtttcaaggtaaccatggtgccaaggtcctgtgggttgcaccagaaaaggccatcaattttccccttgcctgtaatttaacattaaaaccatagctaagatgttttatacatagcacctatgcagagtaaacaaaccagtatgggtatagtatgtttgataccagtgctgggtgggaatgtaggaagtcggatgaaaagcaagcctttgtaggaagttgttggggtgggattgcaaaaattctctgctaagactttttcaggtggacataacagacttggccaagctagcatcttagtggaagcagattcgtcagtagggttgtaaaggtttttcttttcctgagaaaacaaccttttgttttctcaggttttgctttttggcctttccctagctttaaaaaaaaaaaagcaaaagacgctggtggctggcactcctggtttccaggacggggttcaagtccctgcggtgtctttgcttgactcttatatcatgaggccattacatttttcttggagggttctaaaggctctgggtatggtagctgatatcactggaacactccccagcctcagtgttgaactcttgataattaactgcattgtctttcaggttatgcccaattcgtcttattacctctgagtcgacacacctcctactatttattgaatactttgattttatgaaataaaaactaaatatctctcaaaaaaaaaaaaaaaaaaaaaa

SEQ ID NO: 126 - DNA, 23 bp, Artificial Sequence
  Primer
tgggttagagaaggcgtgtactg

SEQ ID NO: 127 - DNA, 18 bp, Artificial Sequence
  Primer
tcagcggcaactgggaaa

SEQ ID NO: 128 - DNA, 25 bp, Artificial Sequence
  Probe
cgttggcacgacaccttcagggact

SEQ ID NO: 129 - DNA, 20 bp, Artificial Sequence
  Synthetic oligonucleotide
gaagcccttgccagccatgt

SEQ ID NO: 130 - DNA, 20 bp, Artificial Sequence
  Synthetic oligonucleotide
tgcctcctccttgggaatgt

SEQ ID NO: 131 - DNA, 20 bp, Artificial Sequence
  Synthetic oligonucleotide
gcttagattctccttaaacc

SEQ ID NO: 132 - DNA, 20 bp, Artificial Sequence
  Synthetic oligonucleotide
aaatgcttagattctcctta

SEQ ID NO: 133 - DNA, 20 bp, Artificial Sequence
  Synthetic oligonucleotide
taaaatgcttagattctcct

SEQ ID NO: 134 - DNA, 20 bp, Artificial Sequence
  Synthetic oligonucleotide
cagcagatcaagtccaggga

SEQ ID NO: 135 - DNA, 20 bp, Artificial Sequence
  Synthetic oligonucleotide
taggtgttcccatacgcaca

SEQ ID NO: 136 - DNA, 20 bp, Artificial Sequence
  Synthetic oligonucleotide
gctaggtgttcccatacgca

SEQ ID NO: 137 - DNA, 20 bp, Artificial Sequence
  Synthetic oligonucleotide
tcaactgtctccaggcagga

SEQ ID NO: 138 - DNA, 20 bp, Artificial Sequence
  Synthetic oligonucleotide
cacatcaactgtctccaggc

SEQ ID NO: 139 - DNA, 20 bp, Artificial Sequence
  Synthetic oligonucleotide
gacacatcaactgtctccag

SEQ ID NO: 140 - DNA, 20 bp, Artificial Sequence
  Synthetic oligonucleotide
aacccaatggtaagcccaag

SEQ ID NO: 141 - DNA, 20 bp, Artificial Sequence
  Synthetic oligonucleotide
taaacccaatggtaagccca

SEQ ID NO: 142 - DNA, 20 bp, Artificial Sequence
  Synthetic oligonucleotide
tggaatttgaatgcagtggc

SEQ ID NO: 143 - DNA, 20 bp, Artificial Sequence
  Synthetic oligonucleotide
gtacacactatacacatttt

SEQ ID NO: 144 - DNA, 20 bp, Artificial Sequence
  Synthetic oligonucleotide
gccaaaaatttacaacccat

SEQ ID NO: 145 - DNA, 20 bp, Artificial Sequence
  Synthetic oligonucleotide
agagactaaaatcaaggctc

SEQ ID NO: 146 - DNA, 20 bp, Artificial Sequence
  Synthetic oligonucleotide
agaactgaaattccttggtc

SEQ ID NO: 147 - DNA, 20 bp, Artificial Sequence
  Synthetic oligonucleotide
aagtactctttcagtggttt

SEQ ID NO: 148 - DNA, 79001 bp, Homo sapiens
ataaaaattaaaaaccctgatagtatcagcacatacacagaaatcactccattatgcaaagttcatcctctattatgaaaggcaaaatgtctacatttcctatcaaccactggcttcaattcagtaaaacttgcataccaagtaggcaaggtggaaaagaaaaaggcagaacatttcatgtatttcaattcagacgcataaaaatgtcaagccctacacgttatcagctttcgtatacaccgtcttctgcattcgcctgtacgggccaatgggctagctggtcggcgtttgatgcttgaagtgatggaacggagtacggggttaaatccactaccctctccccacgcactctagtaattactctatttccacgtcatgtttccgggtgtgtgtgtccctgctcacgcagaaactgaagttcaaagcaggcggagtcacccatgttctttttgttgtccccagaacccaattcaggagttgggtccccagaggatctggagatacctggggactatctaactagctgattcccgcgtggtaagaggctctcaacctcgccaccacgtggtgccaagggccgggaaaagggagagcgggcaggagggagctgtatcaggggcatttaaagtgccttgacgtcacgcactgccaggaactcagctgagttttcagcaggacattccggtcatcttccctccctccccccgggcttctgtgcccaagtcctcggctcttccctcgctgtggcggagggaggagcaccgaactgtcggaacagccagcacaggggcgtatcagtctcctcttggctccgccctttctcctagctgctctcctcattggtcagtgggcggggcttcggctgtaccgcacacgcactgggacctctgggtggccgaacgagctggcctttcatgaattatgcatgacggcgtgcctcggccaggctggggctgggcgaggattggctgaaggggctgtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggtgaagggggtgcagggtggggccgttggggaggcctggggacccgggggctccgcagcggcagggggcctctgggaccttggggatgttgtgatggacgctgcagtggggccgggagagatgaagagacgcggagggtcgccctgagggaagactcttcgggatgacaggagcgggcctcggaagggactcggggcgctggagggaagtttcgttcttcggagaaacagaacgcgctcgagggggcaccgtggggcgagggcgcactcggttgcggcggcaggagtgagggacagtcccccgatttcctgctccctggggccctggggacgttccggccaccggagcgactgtcacgccgacggggatcaccggcgcgagtggggggtcggaaagcgcctcctccccgcccggtcggcggctcccgctgagccacttcctccgcttgccctgttcccgctccttcaggagacagctgtgcccttttggaggcaggaataggtgtgtctgtcgcctgcagccttacgggctggctggtcgtgggtaggctttattgcataagaatcaagtttcctgtagggaaattgacagaccggtactctttctaaattccctcgcatctttttctaggttaaattatgctccccccacgtccccgccttgtaaaaaagagaaaaaaagacaaaataaaatccccatcaacccgtcaagccagctctagagagagaaataaacctcttgacattgtccttttccaaatacctggtaaagtcggccagaagataaataattgagccattgcatttactggattgtggtgttgcttaattgcataggacggaatgaaccaattgagagtgggagttttctgtctcagagccaagatcttgggtaaatgcagaggagagggaaacaaagacaggctggccttgaaaaaaccatgtgtgcaaactttacatgcatttggggggtgtggttgcactgaagttaacaagattcaaaccgtcgcccaagttggtatttccatgtttggtacacatcactctgtgccatatcaggtcgttgttaagtgtggtgacaaaatcagtggttagtcatttttttaattaaaaatgtgtatagtgtgtacctgctggtcttactgtatgtgcaactaaaggtttacatagtctgtgtatgggttgtaaatttttggctggctgtgctgataaagcattgggcttgaataaagcaaagcagaaaatcatctcaatcttttatatgtggatttagactgtgttatgacttggttcagccagttttctatcttattttatattaaatatgtctgtgttctctgagtcagcacatttatttccttattacatgttccagacaggagtgctagcccagtttttgttcagtttgcacagtgggatggggaaacaagtctggaatttaaaaaaaaatgttttagaggttggagccttgattttagtctctatattagcacatccatcacaaagaaccattagtaaattcatgaatcttttgttttttatgtagttcatttgagaagaataatcacttagaaatatccacagtgccaggcatggtggtgcacacctctgatcccagctaattgaaggctgaggtgggaggattccttgagtccaggagttgagtctggtctgggcaacatggtgagaggccaggaattgggtctagagtctagtctaagcaccataatgagaacccatctttaagaaagaaagaaaggaaaggaggaagaaaggaaagaaaaagaaatacccacagcacagttatgaattaacccacaaaggacttgtgaggtgggtagttcacataacaattaccctaatatcgtagataagaaaattgaggccaaaggatcaagacacttggccaacgcagcagagtgccatagtggtggaatttgtgcctccttctgtatattttgtgaaaagtatcagtgaaattctttttttttttttttttgagtcagagtcttgctctgttgcccaggctagagtgcagtggcgcaatcttggctcactgcaacctctgcctcctgggttcaagcgattctcctgcctcagcctcccaagtagctgggactacaggcgtgcgccaccacgcccagctaatttttgtatttttagtagagaccggggttttaccatattggccaggctggtcttgaactcctgaccttgtgatttgcccacctctatctcccaaagtgctgggattacaggtgtgagccaccgcgcccagtaagtatcagtgaaattctaacatatatctgaacagtaaaataccaccaataggctgaaagacttcatgggaggtaaatattcaataaacaggtgaaaaaagaaatacaaatggagcttgcttagattatttttctaattgctatgtctaacttgggaagtgaggaactgtttttggtcagcataatttaccatcagaatttagctatttactaatgaaaagaaatactaatctaggtttgttttagattaaggacagtcatgacctaaatgtcatttaaaccagagtgcattgtggcttgatcagtggtcatttctgtctctagaaagttgctttaacttctctgcctctacgtgtctcttgacattcagatatgaggtggggtagaggtggtgaccaactttccagacgcctgagtccaaaccttcttagcttatggttttcttaggtgatgtgcaaatcaacaaatatatacttttttttttttttttttgagttggagttgcactctatcacccaggctggagtgcagtggcatgatcgtggctcactgcaacctcctcctcccgggttcaagtgattctcgcacctcagcctcctgagtagctgggattacaggtgcccgccactacgcccggctaatttttgtatttttagtagagataaggtttcactatattgaccaggctggtctcaaactcctgacctcaagagatctgcccacctcagcctcccaaagtgctgggattacaggcgtgaaccaccttgcctggccaacatatatataccttttgcaactttgtcagagttgctatgaagaataagttgtatcttgttcacagaaattgcagtctactgggggagctgataaatgttttaaccatccaatgtaacatgttgtcatcaaagagatggtgagactttacacttgtgctaacaaggtagctgttctacataaaagaacatacagtacagatgtagaacttttctgttatcatagaacgttctattggacagtgctaggctgaatgctacagatcttcagagaaaggagaggttatgaggcctggagttgtctagaaagtctttttgccaaagagggatttcaactgggtcccaaataatgggtggaatttgataggtgtaaagaatttgcggtggtttatgcctgtaatcccagcactttgggaggctgaggcaggaggattgcttgagcccaggagtttgagaccagcttgggcaacgtggtaaaactccctctcccctaaaaataaaaaaaattagccaggcctggtggcgtggacctgtagtcccagctactggtgagactaaggtgggaggatcacccaagccccgggggttaaggctgcagtgagccgtgatcccgccaccgcactccagcctgggtgacagagtgagaccctgtctccaaaaaaaaaaaaaattcctggtagcccggtagactaggagggtaagtaggggagaagtgattacttacaaaagacattgaatacaggaccaaggaatttcagttctgttcttttgtaggggaagcttttaaaactttcggggcgccgggcgcggtggctcacgcctgtaatcccagcactttgggaggcccagacgcgcggatcacgaggccaggagatcgagaccatcctggctaacacggtgaaaccccatctctactaaaaatacaaaaaaaagtagccgggcgttgtggcgggcgtctgtagtcccagctactcgggaggctgaggcaggagaagagcgtgaactcgggaggcggagcttgcagtgagccgatatcgcaccactgcactccagcctgggcgacagagcgagactccgtctcaaaaaaaaaaaaaataaataaataaataaataaataaaactttggagccgaagcactgatgtttaatcatagagtgcttactatgtgttaggcacaggcctgattgcctgatgctggttaatttgtacaaagtaaatcagtgcatatgccctctgccctaggggagttattaactggagtctgacattgtacaaaggtaggtatcctgactagtttgatttggtactttgggtgaaaaaagtatagtgtgcttaagtgcagaagtgttttttgaggatttttgattggatacaaaccaccactcatattttatgtctttggcacttaaaaatttcaccataacttttgagtcatttataaaaaccactgaaagagtacttgagggacatccccgaatcctgaagaacttctggtgttctggagcagcctcagtgagatccaggaggatggcattgctgggctggcccagcccttattgattatggtgtaaagaattaatatggtggttatatactctttgttagacaccttggcttacaagacgtaagcgtaaagtgtagtgcgctttagtcagtatggccacatggtcctttggtggtaaattgtttgagatgcctccagtttttaaaaggagtagcatatcgggccaggagcagtggctcatgcctataatcccagcactttggaaggccgaggcaagaggattgcttgagcccaggagttcaagaccagcctgggcaacatagtgagaccactttgtttctttaaaaaaaaaaaaaaggcaaaaacaggctgggcatggtggctgatgcctgtaatcccagcgctttgtgaggcagaggtgagcggatcacttgaggtcaggagtttgagaccagcctggccaacatggtaaaaccccgtctctactaaaaatacaaaaattagccaggtgtggtggcacacgcctgtagttccagctactctggaggctgagccaggagaattgcttgaacctgggaggtggaggctgcagtgagccaagatcctgccactgcactccagactgggggacagagtgagacattctgacagtgctacactgaatgctacatgtcttcagaggaaggagaggttatgaggcctgggaataacatatggaagaatgaatttctgttatggtcagttctcatttgtcatgttaggattactgcaactcttacccagccgggtgtggtggctcatgcctgtaattccagcactttgggaggctgtgggcggatcacgaggtcaggagatcgagaccatcctggctaacacggtgaaactccgcctctactaaaaatacaaaaaattagcccagcgtggtggcagacgcctgtagtcccagctactcaggaggctgaggcaggagaatggcatgagtcctggaggcggagcttgcagtgagctgagatcgtgccactgcactccagcctgggcaacagagtgggactccatctcaaaaaaaaaagaaaaaaaaaaggattaccgcaactctttaattcagatcagcaaacatgttgagagccaggtattgcgtcaggcaggatccaaggataatgaaatattgtccgttttcatgaaactggagatgttgcagggaccgaggtgtgtgctatgccagtatggaagtaggacaggggagacgacagggcagtgagtggttcaagactctggctctgaagtcaaacagatctgggactgaatcctggatctgccacttcctagtcagaatctgagcctctattttcttatctgtaaaagaagattataacagtgcttatcttgtaggtactgttgacgattcaataagataatgtggataaaatgcttagcatagtgcctggcacatagtaagagctcggtaaatctaagttcttactaaatatccaagaaaagagattaattcttttcaggagtgagagaaagtcatcattattgaggggctttatcagatgggaacacctgaatagggttttataggatgaataggaattctttccacgaagttgcgttacaaaaagttgcattcaaggctgaaggaacatgagggtgcagaggcttaaaacagccttgtgtgttcagggagctataagtagaagttcttaatttaggagaactaaaccaaggggaaaggaggccaaggaaccacagttcttatcccttttctgttaataattgggtttaaatgtcattaaaataagttattttgtcctttttagaaaagtaataacatgctattataaaaaaaaagacttgtaggaatataaaatgtgtgttttacatgtatcctgttaattgacttgcttttattcagattttttgcagccctttctgtttaccaggttatcttggagacatatttattccaaattcctttttttttttttttttgagatggagtctcgctctgtcgcccaggctggagtgcagtggcgctatcttggctcattgcaagctccgcctcccgggttcacgccactctcctgcctcagcctcccgagtagctgggactacaggcgcccgccaccacgcccagctaatgtttttttttttatatttttagtagcgacagggtttcaccgtgttagccaggatggtctcaatctcctcacattgtgatccgcctgcctcggcctcccaaagtgctgggattacaggcgtgagccagcacgcctggccttccaaattccttttaacagcctagcaaaagaataataaggaaggtaaatctgcccctacaagaaaataatgcttcgacgatccggctttccttcctgctacccccagccataagaataaatgaccttgctcatcactgaaattttacctgacctttgaatttttaactgcgtcagccaaagaacttatattttgagtattcctaaggtgattgctattgtagttttgaaacacttggttggtatgtttgagggtttcatggtccaaagttactatagcagttaaaagagtggactatcaggtcagacctattgggctttaatcccagttctgccttctcttagaccttgggcctgttgttttcacttctctggttttcagtttctctgtccacaattgtggaaacgaggtccacttgtagagtaattgagaggatgaagcaagatgatgcatatcaagtactttgcatagtgccgggcagacaggtaacattcaagtgctaataattactattattactatttattttttgagacaggttctcactctgtcacctaggctggagtgcagcggtgagatcacagctcatgacagccttgacctcctaggctcaagtgatcctcctgcctcagccttcggggtagctggggctacaggtgtgtgctaccaccctcagctaattttctaatttttttgagtcaggatctcgtcacgttgcctaggctgaattactcttattaaaaactataatatcaggccgagtgcggtggctcacgcctgtaatcccagcactttgggaggccaaggcgggtggatcacctgaggtcaggagttcaagaccagcctgcccaacagagtgagaccccccccgtctctactaaaaatataaaaattagccagttgtggtggtgggcacctgtaatcccagctactcgggaggctgaggcaggataatcgcttgaacccgggaggcggaggttgcggtgaaccgagatcgtgccactgcactacagcctgggtgacagagtgagactctgtctcaaaaaaaccgaaaaacaaaaagcataattagggtggtaacgcttatacataggggcaggtggaataaaacataattaggaggtcgggcatggtggctcacgcctgtaattccagcactttgggaggccgaggcgggtcaggagttcaagaccagcctgcccaacatagtgagaccccgtctctactaaaaatataaaatttagcctgttgtggtggcgggtgcctgtagtcccagctacccgggaggctgaggcaggagaattgcttttgaacccaggaggtgggggttgcagtgagctgagatcgcgccgctgcactccagcctgggagacagagcaagactccgtcacaaaaacaaaaaacaaaaaactgtcatatcaaaaactaaactaaaatggtaatatctgttagatattacaaagtcaggcaaattatgattcatggcagccactaatgacccaaaggagagaaagaataattagcagattctaacctaatgggaaaaaaactaaatgaatagggatgggggacttacattctgttagaggaaattgaggctgtcatataaaaggaataggtaaggcaaactgtaaattcctgtttacacaaatgcccttctgataaatctctgcattgcccacagtccatgattacctctcccttattttaagtaatatttaacacattaaaaatggattaccacccaaggaattgctcccgacccagaaagtgcaggtagtgttgaaggtttgaggggaagaggaatgattagagttggttgtgtctcaggaagaagccaacaggaggaaccttattttgagtcaggtaaagaaggtgggagtgaggaggcatcccggtggccaggtatgaagctgggagctgattgctgcacattactcagctgaattaaatgtgccctcacatctgtgtgtgtgcgtacatgcaaatgtacatgtgtatgagttagttggaggggtagacctttattttcctgtcctgtaactttcctttgcaaactaatctgtattcagaacagtgttgcagttaagaaccacccagcttgtccatgaaacaggttctctcaccccatctccccagttttagagaaggcaggaaagaaaaggcagtgcttttcttttttcctggccgtatgcggggcaggaagaagccagcagagcttgaaagagaaagtaaaccttctgggaaataaacggcttggcttccctattgtggaggaggagtgcaaattattagggggatgtttgggtagtttttgtagaagccatttctgaaaactgatttggattagtgaaggtaagcccaatttaggaaaaccctgcccagtctggtgtcagccacctgtttcccgctttgtttgattgatttgattagtttgtggtattctgacctctcatttttattacaagagttggaagatttgagtctgaacttgagcacctgcttcggtgaaagcttcctaaaatgcatgttttttcacattttttctcatgttcattttgttttgctttttagcaaacactttttctgacagaatctaaaagcattagacttttcttgttttccccttctctccccacaatgtaatcttgaaaacccaaatgttagctgtgtaaattacctctcccgtaaaccaaacaaagtgcaatattgcattgagttagcattgaaatagtcggcctttgaatttttttctacttgtggtttagacataataaatatttcatctcagactgactttctcgacaaatcagttttgcatttgggcctcttttcatcagtatgtttagggaaagcacatttattgaaacattaaccaaaatgaaacataattaggaggccgggagcgatggctcacgcctgtaatcccagcactttgggagaccaaggcatgtggattgcttgaggtcaggagttcaagaccatccttgccgacttggtgaaatcctgtttctactgaaaatacaaaaaactagctgggtgtggtgacgcgtgcctgtaatcccagctactctggaggctaaagcaagagaatcgcttgaacctgggaggcagaggttgcagtgagtcgagatcgtgccactgcactccagcctgggcaacagagactccgtctcaaacaaccaaaaaaacaaaaacaagcataattagggtggtaacgcttatacataggggcaggtggaataattgaagcattctggagccagaaataatcaactgattaagaataatctggctgggtgcggtggctcacgcctgtaatcccagctactcaggaggctgaggcaggagaatcgcttgaacctgggaggtggaggttgcagtgagccgagatcgcgccattgcactccagcctgggctatggagcaagactccatctcaaaaaaaaaaaaaaaaaaaatcctgtttctgcagaaatatcccaggtgtcctgggtcagcagtgccccatagattccacggacgtttaccctaagttttccaatgggagttcatacctctatacccagtgagaatattttctgagtaatgggaatgagattggagatgtagggtagagaagatccatacagtctttgggttaaactttttcctctttgcctaggaaagattaatgctaatcttaaccacagatttgtagtaagaatgtatcagttttgtcattcagttctagactccagttttctttattgtaataccaatattttagagtaaattttgaaatgaatcagtacaaaagatatgtagtaagtggaaagttagtccgcaccttatccttgggactctttcccagggacagctagttacctactatttatctctcctgagttacttcatatgtatgcatgcaaacatgttattctctgggtgttgttccttccatatatagcagcaaatacaccaaactctgtattttgctttttgtcactttatcttagagaatactcaatgcaaatacatgtgtatatacctcatgtttaaaaaatctacatagtaaaattagccaggcatggtagtgtgtgcctgtaatcccagctactcgggaggctgtggtgggagaatcacttgaaccctgagatcacaccactggactccagcctgggccacagagcaagattctgtctcaaaaaacaaaaacaaaaacaaaaaaactacagagtagtattctaggctatgcatatcataaatttgatttcctaatgataggcatagatgatttgcctgggcggcaaattagcgttggctgtgtctcaggaagaagccaacaggaggaaccttattttgagtcaggttccaaagacagaaacattgtctgacatttgtttttgggcttatatgaataaatctgtacacatatatttttaatgttttaatcgtaatatgtatactatttggaaatgtggctttttagttaacagagtgcatgttttaccccattgcacttaaacattaacttggggataattaaatgagtctgtcacttggacaggcaggaattgtaccccccacaaacccataaaccgccaattttttttttttgagacagagcctcattctgttgcccaggctggagtgcagtggtgcgatctgggcccactgtaagctcagcctcccgggttcatgccattctcctgcctcagcctcccaagtagctgggactacaggcgcccgtcacaatgcccggctaattttttgtatttttagtagagtcggggtttcaccatgttagccaggatggtctctatctcctgaccttgtgatccgcccgctttggcctcccaaagtgctggaattacaggtgtgagccaccgcacctggccggtttttttttttttttttgagatggagtcttgctctgttgccaggctggagtgcaatggcatgatctccgctcactgcaacctccacctcccgggttcaagtgattctcctgcctcagcctcctgagtagctgggactacaggcgtgtgccaccacgcacagctaatttttgtaattttagtagagatggggtttcattaataatcattaatattagacaactgtcagactcacagtggtggatacaaactttctcaaattctgatttttactctaaagctcaaattttatcattggcaacaaatattgtcagttgctttccctgaacagacagcttcccttctttcatttttgagaaaatatctgccagtatcccagttggtttatcaatcattctttctctttttttttttgagacggagtctcactctgtcacccaggctggagtgcagtggcatgatctcggctcactgcaacctccacctcccaggttccagcaattctcctgcctcagcctcccgagtagctgggattacaggggctagcagccacacctggctaatttttgcatttttagtagagacagggttttaccatgttggccaggctgatcttgaactcctgacctcatgatatgcccaccttggcctcccaaagtgctgggattacaggtgtgagccattgcgcccggctctattatttcttttctttctttctttttcttttttttttttgagatggagtttcgctcttgttgcccaggctggagtgcaatggcgcgatctcggctcaccacaacctccgcctcccgaattcaagtgattctcttgcctaagcctcccgagtagctgggattacaggcatgtgccaccacacccgtctagttttgtatttttattagagatgggggtttctccatgttggtcaggctggtctcgaactcccaacctcaggagatctgcctgcctcagcctcccaaagtactgggattacagttttgagccacctgacccggtttgcttattatttcttttaaatttaaaaaataataaataaaggggccatgagagcgaagagtttgagaaaggttggtctaaaggttttaacataagaatccctgggttatttgcttaaaaagaagaaagaatctatggatctgcctgagagggtctgatgtagtttatctggggtcatcctcacaggcatagcagatattctgattcagatggtccttggtccttagtttgagaaatgtggctttacaaggcccatagaatataaagtcttctttggattagtgaagtcatgtccacagggtttagaaaatgtttttgttttagagataaaggtaagtggaagagtagacatgtagtgaatgagggaaaatgttttagagatttctttttattctgtttactcttcttggtatgcacgtacctgaatattaaggatattttatgaagtcatgacattaccagattaatgttggttttgttttaaggtactttctgactgctggggttaattcctacagacgattctggtaaagaatagcctttaagttttaaaagtgttgacttatttcagatgtcttaataaagttaacttccagttattacatgtaacgtatataaagctctcattttcctttattctcgttaattgtttgcataacaaattcaaagggaaatttgcttggcagagatcagatagcagagatgagatttaaaaacaggtaatttggctactagcctgggagtttgaagattccaagtttgcatccatgtgtagtcacttaacatttctgtccttatctgtaaatgggaataacacctacttgatagggttgttacattatcttggccacctcaggttctctttggctgagtgattgactggaaaacgcaatgtgaattcatgcttcagactgggttcttttttttttttttttttgagatggagtttcactcttattgcccaggctggagtgcaatggcacgatctcagctcactgcaacctctgcctcccaggttcaagcgattctcctgcctcaggctcccgagtagctgggattacaggcatgcaccaccatgcctggctaatttttttgtatttttagtagagacggggtttcactgtgttggtcagactggtttcaaactcctgacctcaggtgatccacctgcttcagtctcccaaagtgctgggattacaggcatgagccaccgcacccagcccaggctaggttctatatgggtgtgctttttagaatttagatcatgggctatccccaacacaaactggataatgtttctttctagattctctctaagcgtgtattctctttctttcctaggcacagccaccacttcacttacattgtgggattataatttcatgagtagtggaatttccttaaccttctcttgtgtgggagctgaaggacaaaatgagatattctctgaagagtggttacatcatgcaaaactatgatgtgtaatgaggtcacttagttttctaagtacattatacattttgataagattttcatagaaaagcttgtctccttggggagatcactcatcttccatcttgactattatttaaactttatgggtcagatttatctttttaaaaacttaaccataaagctcaattaattttttttttttttttttgagacggagtctcgctctgttgcccaggctggagtgtagtggcgcgatctcggctcactgcaagctctgcctcccaggttcatgccattctcctgcctcagcctcctgactagatgggactacaggcgcccgccacgatgcccggctaattttttgtatttttagtagagacggggtttcaccgtgttaggatggtctcgatctcctgacctcgtgatccacccgcctcggcctcccaaagtgctgggattacaagcgtgagccaccgcgcccggctcaattaatatattttaaaaattaatagactttattatttttattttattttatttttgaggcagagtctcgctctgtcacccaggctgagtgcagtggtgtgatcttggctcactgcaaactccacctcccgggctcaagtgattctcctgcctcagcctcctaagtagctaggattacaggtgcctgccaccatacccggctagtttttgtaattttagtagatacgtgttttctttcttttcttttcttttttttgagatggagtttcactctttttgcccaggctggagtgcaatggcatgatctcggctcactgcaacctccgcctcccaggttcaagtgattctcctgcctcagcctcccaagtagctgagattatagttgtctgccaccacgcctggctaattttttgtatgtttgatagagacagggtttcactatgttagccaggatgtctcgatctcttgacctcgtgatccgcctgccttggcctcccaaagtgctgggattacaggcgtgagccactgcggccagtctagactttattttttaaagcagtgttagttttacagaaaaattatgtggaaagtacagagagtttccatataccccttactttctcccacaacttctattattaacatcttgcattagtatagtacgtcccttacaactaatgaaccaactcgatacattattattaaccaaattcctgagtttattttatttctatttttattttattattattattttttagaggtagggtctcactgtgttgtccaggccaggttgcagtggcatcatcatagcttgctatagcctgaaactcctgggctcaagcaatcctcctgcctcagtctcccaaagtgttggaattacaggtgtgagccactctgtccagcctgaagtccatagtttacattacatttcactctgttgagcattctatggattttgacaaatgtgtgatgatgtatatttgccagtacacaattatataaaatagttttactgccctagaaaccccctgtgctccacctattcattcctctgctgaaccactggcaaccactgatcttttataatatctccatagttttgtcttttccagaatgtcatatagttggacatacagtgtgtagccttttcagattggcttctttcagtaaatgatatgcatttcaggtttcttcatgtttttttgtggcttgataggttgtttcttttcattggtgagtaatactctattgtatggatataccacatgttgtttatcaaacattcacctgaaggatagacatcttggttgcttccaagtttgagcagttatgaataaagctgctataaacattccagtgcaggacttttcacctcctctggataaatatcaaggagtgcaattgctagatcatatggtaagagtatgtttagttttgtaagaagctatcaaactatattcaaagtgactgtaccattatacattcccatcagcagtgagtgagagttcctgttactccacatcttcaccagcatttagtggtgtcagtgttttggattttagccattttaatgggtgtataatggtatacctattaaaattggttttttttggagacagagtttcacagtttcactcttgttgccctggctggagtgcaatggcgcaatctcggctcactgcagcctccgcctcccagtttcaagtgattctcctgcctcagcctcccaagtagctgggattacaggtgcacgccaccatgttctgctaatttttttgtattttagtagagatggggtttcactgtgttacccaggctggtcttgaactcctgagctcaggtaatccacctgcctcagcttcccaaagtgttaggattacaggcatgagccaccgcacctggcctcaatttttttttttttttttttgagacagagttttgctcctgttgaccaggctggagtgcagtggcacaatctcggctcactgcaacctccgcctcctgagttcaagcgattctcctgccacagcctcctgagtagctgggattataggcgcccgccactacgcctggctaattttttttttttttttaattagagacgaggtttctccatgttggtcaggctggtcttgaactccccgttctcaggtgatccgcctgcctcagcctcccaaagtgctgagattacaggtgtgagccaccgtgccccgcctgttttggcttttactgtgaagacgtgttagccgctgtgatgactagcaagtgtggccctccacccagtcgctctgggctcccagctcctgcatcctgctgcaaacttgacatcttccctcaagtaacttgtagttgtctcctgtctacttgcccaaaatataactcttaaacttttctctctgcaagtttgtgcctctctccctgtctgacttccccatctaaataaatggtagaccaccatctactcctttgtgcaagccagaaatctaggaatcatccttaaattccctgttctgtcttatctctgctttcattcaaagcatcagcaaatcctgttggttctacctctgaagttttctcaaatactgttacttgactcatcctgacttttgtttctgctttatgttaggctaaatgccctgaaaactcttttgtacaaaacacctagaaatactggataaactgggcttaacagggaggcccggtgtggtggctcacgcctgtaatcccagaactttgggaggccaaggtgggtggatcacctgaggtcaggagttccagaccagcctggccaatacgtagtgaaaccccacctctactaaaaaaaaaaaaaaaaattagctgggtgttgtggtgcacacctgtaggtggtgcatgcttgaacttgggaggcggaggttgcagcgagctgagatcgcgccactgcacttcagcctgggtgacagagcaggattctgtctcttaaaaaaaaaaacaaaaaaagaaaaacaggaaaatcttcagaagcaaaaaccaaacaatctcaccaaagaaatgagaagatggctgggcgcggtggctcacgcctgtaatcccagcactttgggaggccgaggcgggcagatcacccgagatgggcagatcacccgaggtcaggaattcgagaccagcctggccaatatggtgaaaccccgtctctgctaaaaatacaaaaattagccaggtgtggtggcaggcgcctgtaatcccagctactcaggaggctgaggcaggagaatcgcttgaacctgggaggcggaggttgcagtgagccgagatcatgccactgtactctagcctggacgacagagcaagactctgtctcaaaaaaaaaaaaggctgggtgtggtggctcatgcctataatcctagcactttgggaggccaaggtgggcggatcacttgaggccaggtgaacatggcgaaaccccatctctactaaaaatactaaagttagctgggcatggtggtgggtgcctgtaatcccagctactcgggaggcgaggcaggagaatcgcttgaaccaggaggtggaggttacagtgaaccgagatctcgccaccgcactctagtctgggcgacagagcaagactccgtctcaaaaaacaacaacaaaaaaccaacacatggccaaagtgcagtgacttacatctgtataatcccaatgttttgggaggctgaggcaggaggatcgcttgagtccaggaatttgagaccagcctgggcaacatagacctcatcaccaaaaaaaaaatattttttaattagctgggtttggcagcatgtacctgtagtcctagctactcaggaggctgaggtgggaggatcacttaggcccaggagtttgatagttcgaggttatagtgagctatgatcctgccactgcactccagcctgggccacagagtgagaccctgtctcttagaaacaaaacaaaacaaaaaaaagaaactgaattaaaaacaacaagaacaaaaatgctgctttttgttattgagttgtagcccaagtttcttgagggtaaagcattgaaaagcaggcagtaatagatttgctgtttaaagagatttacttgcagcactattcacaatagcaaagacatggaatcaacctaaatgcccatcagtgacaaattggataaagaaaatgtggtacatacactgtggaatactatgcagccataaaaaacaacgagatcatgtttttgtttgtttgtttgtttgtttgtttttgagatggagtcttgctctattgcccaggctggaatgcaggtggcacgatttcagctcactgcaacctccgcctcccaggttcaagcaattctctgcctcagcctcccgagtagctgggattacaggtgccctccaccatgcctggctaatttttgtatttctagtagagatggggtttcaccgtgttgggcaggctgttcttgaactcctgacctcatgatcctcccacctcggcctcccaaagtgccgggattacgtgtgagccaccgtgctcggctgagatcatgtttttgcaggaacatggatggagctggaggctattatccttagcaaagtaatgcaggaacagaaaaccgaagaccacgtgttctcacttataagtgggagctaaatgataaggacttgtgaacacaaagaaggaaaccacagatactggggtttacttgagggtggagagtgggaggagggagaggaacagaaaagataactattgggtattgggcttaatacttaatattttatcaaaataagctgtacaacaaacccctctgacatgagtttacctatataacaaacttgcacgtgtaaccccaaacctaaaataaaagttaaaaaaaaaaaaaaaggctggttgcattgggaggctgaggcaggcagagcacttgaggccaggaattcgagaccagcttggctaacgtggagaaaccctgtctctactaaaaattcaaaaattagccaggtgtggtggtgcatgcctgcagtcccagctaccagggaggctgaggcaggagaattgcttgaactcaggaggcagaggttgcagtgagctgagattgcaccactgcattccagcctgggcgacagggcgagaccttgtctcaaaaaacaaaacaaaacaaaacaaaaacctgtcactttgggaatatctcaaacctagtcatccaagtggttgtacgattttagtgtctgcatatcaatatttagtgtgatctactttcttagattctcaaatactgccaatgggcacatgtcatgaaataatgtcttttagaggacaagagagtgctaaagtctcattattgcagtttaagaaaaacaattctgtaacagtttaactttataggaaatgccttttgtttatttattttttttcttttgaggcttagatttttatttttatgtttttagagatggggtcttcctatgttacccaggctggccttgaattcctgggctcaagtgatcttcctgcttcagcctcctgagtagctgggactagacgtccactactgctcctggctggaagtttagattttaatttaaactcttctattgggaaactttgtatgtttgctttaccacttaacatttgcatgcattattgtacctattgtctcctacttaaggaagggcagtttatgctgttatatgaagtgaattaacctcctatggtacttcagttttctctatgctaaaagtgtgttctagatttttgaaaaacttacttaattttcattcatttattcaaatatttgagcattctgtagttgctggggaaatagcagtgaactgaagaatgtctttgttcttatggggcttaagttcctagttgatcatattggaaggagatacatgaaaaaagaaatatatgaacaatggagggcgatgagtactgtaaaggagaattcagcaggggagatgttgctgttttagatagaggggtgtcaagagacattgtgcagagacctgaacgaagtgagggagcaagccatggagatatctagggaaagagcctatcaggtggagagaagagtcctagggcagaaacgggcaaggtgtgttccaggagcagagaggggacagctgtgagcaaggggagagttgtagggaaggaggcaaagagagacatctggggcaaaatggattgactggtgggccgtggtaggactttggattttttcctgagtgggttttgagcaggggaatgaaatgatctgactctggttttttttttttttggagacaaaatcttgctctgttgccgaggctgaagtgcagtggcgcaatctcggctcattgcaacatctacttcctgggttcaagctatgctcctgcctcagcctcccgagtagctaggattacaggcttgggccaccatgccggcgaatttctgtttttatttttattttttatttatttttatgtttatgttttttgagacggagtctcgctgtgtcacccaggctggagtgcagtggcgcgatctcagctcactgcaacctctgcctccccggttcaagcaacttctcctgcctcagcctcccgagtagctgagattacaggcgcctgccactacacctggctaatttttgtatttttagtagaaacgggatttcaccttgttggccaggctggtctcgaactcctgaccttaatttatctgctcgccttggcctcccaaagtgctgggatgacaggtttgagccaccgtgccagccaggactcttattttgaaaggatctgtaatgtggagaatagaaggtagagggacaaggatgaaagcatccaggccagttagcctagtccagctatctaggtaagagatgctggtggcctggattaaggctgcgtcagtgggaggttgtgagaaaggctcaccttccttttttttttttttttttttttttgagacaggatcttactctgtctcccaggctggagtgcagtggtgcaatctcagcttactacaacctccgcctcctgggctcaagtgatacccccacctcagcctcccaagtagctgggatcacaggcttgcgccactatatccggctaatttttgtatatttcgtagagacagggttttgccatgttgcctaggctggtctcaaactcctgagctcaagtgatccacccgcctcagcctcctaaagtgctgggattataggcctgagccattgtgcccggtcacttccagattttgaagacagagccaacaggatttgttaatggattaggtgtggcaggaggagggggaggaagagagagagagactggagttgaagttaaggctcatttcaaggtttttagcctcaacatgtgcaggaatggagttgtcacttgctagaatgggggagactggaggagaagccggctgggagaggtttttaatgaaggggttggctttggatacattaagtttgacatgcattttagacatccaggtggagatattgaagaggcagttggctataagtgtctgatgttcatattagcggatggggctagagacataaatttgagaattgtcagtgtataaacgttgttttgaaagaaagtggggctgaataatttagaaaggagtgcatagagaaaataagtttactattaaaatagctttaacaggccgggcacggtggctcatgcctgtaatcccagcactttgggaggctggggtgggcagatcaaaaggtcaggagtttgagaccagcctggccaatatggtgaaaccctgtctctactgaaaatacaaaaattagccaggcgttgtaccgggcacctgtagtcccagctacttgggaggttgaggcaggagaatcacttcaacccgggaggtggaggttgcagtgagccaagatcacgccactgcactccatcctgggcaacagagcaagactccgtctcaaaaaaaaaaacaaaaaaaaacaaaaaaaaaaaactttaacagcaaagcctcttcctttaaaattatgaatttttttcttatggaagttggactctttcattattaagtctacattcaatcactatgttagtaaaaatgttgttctagttgccgaatgcaataaaccagctcagacttagtggcctaaagcagcaatcatttgactatgttcgaagatgccgtgggcaggaatttagataacagcagggatggcttgtctttgctctgcgatgtctgaggtctcactgagaaaactcaagcggctgggggtaataatcatctggaattttctttactcctgtatctgatgtctgggctgcgatgactcaaaggctgatttcagctgagactgtagaccacgtgcctacttgtggcctccccttttgccttgggtttctcacagaatgtggctggttctggagaatgagacttccaatgaaatcaggtggaaatgacatctcgccgctttcagcatgctctattggttggaacagttatggacttagctagattcaaaggaagggaacaaagaccccctcctctcagagagtggggcataatgagagaatttagggccatgttatccaaccaccacaaatgccttctgaatttgaggttctgcctcaaaagttcatagttcctttgactgaaggacttctatatatccaagcatcgtcagccccaggtatattgttccatgtaagtgaccaggactaccttagtatttcgtatagggaaagtgacctgaataaatttgagaaaagaatcttccttctctccagtaagcactgaggtaagcattgagccatattataggtttatgactttgagactcagaaatttaaattcttggccaggcgcagtggctcacgcctgtaaccccaacactttgggaggccaaggcaggcagatcacttgaggtcaggagtttgagaccaacctggccaaaatggtgaaactccatctctacgaaaaatacaaaaattagccaggtgtggtggcgggcacctgtaatcccagctacttgggaggctgaggtaagagaatggcttaagttctctttatctgctttatttcagttgcctctcttagatgaatattaatgacttacatagcattttagatcagtggatgtttttgtgattcttttatttgagctttggccaaagataacagtacccacaggttttttccagctactcgctcttctcccttcagtggccctcgagcctggaaaatctgacatgacaatgtgcttgctcaacctaccactgtttttcttttgaaaagtttggcagcctgtttctgactcctatgaaggtgaattcctcagcattcacagtttattagaaaaatactttgcttctctccaaactcgaaattcaagataaccaaacctatatataggctgatctttcaggatgcagttgtcatgttgatgccatgcttttcagtatcgtggccatcatctgttcagtaggggaggtgtacttctgtaatgggaggtggtggttatgtgtgtgtgcaagtgtttatttggtgtcttaagttagcctgtgggaagttctaaatcaggatggtacgtggttgccagcagagagctgctcctcaagtgaaggaggtagaatcaaagccaataggaaagagcctcagatgcttatatatgtaccgtggggattcagagtgaaagcagtcattggactaggggtggggttagggagagcctgtctgacagacacaagaaagggatggataacgccacccagagaaaaaagcattttaggcaagaacaaatatgaaaaaggaacaaagtctgtgggtggggggcaaggaggagataagttgacttgaaggaagacaacacttatgaaagtcacctggaggctgggtgccatggctcatgcctataatcgcagcactttgggaggccgaggtaggaggacaacttgagcccaggagttcgagaccatcctgggcaacatggtgagactgagtctctaccaaaaaaaaaaaaaaaagaaaattatccagacatggtggcatgtgcctgtaatcccagttactcaggaggctgaggtgggagggttgcttgagcccaggaggttgaggctgcagtgagctgtgatcgtattattgcactccagcctgggtaacagagcaagaccctgtctcaaaaaatgaaagtcatctgtaggctggagagaggaactggaaggggctaaagttggctgagtagttacagagcctgagataagggtaaagattttgcattggacaatgagatgttagtgtgtgtttttgagctggggagtgctgtgattttactcttattgaagaatcactgaaggattattcttgaatcagtgattcttgatcattcttgaatttttcaaacagcaaaactggaagagttggcctattcctcagaatattttctaattgggcgcagtgtcctcacttgggagaacctggctacacactttagttgtaattcactccagtcgttcattcattcaatacctattttttcagcacctattatgagccagacactatgctggatgccagggttcagggtaggacacgctagtgagcaaaagccaagactcttcttgtcttcatggggctttcagtccagcatagtggttatgagtccaagttaatggagtcacagtacttgggtgcaagtcatggtgatggtgatagaaggaaggcatgtgtgagggccagtggcaggcaggagcctggtgtttttgaggacctgaagaaggagcagagtgagtgccaggaacttagccaccagctggtaccagccatacgagaggggcagagccagccaggatgtcggtcatgctagtaatgagtacaaacacttacatgctgcacgctattgggctcctgagtgctacgtgttcattagctcgatgaatttgtacagcaaccctgtgaggtaagcactgttctctcccctttctatagatgaggaaattaaggcacaaagaggataaataactggcaccagctacacgctaagtgatcgaagtggtggaaccaggattcaaatccatgctattctgccttaagataacaaatcttgttttttagcctaagaacagagcagtcatcaggagggttttaagtaggggtgtggcaagatcaagtttgtgtcttgaaaaggtctctctacccacagtgtggaaaatggcctggaggcaagcacacagatgttgggagacagttaacagctcttgccatggccccctatgcattttggctctgatgtttctgcctgatttttctcttgcctctgcctcttttcctgaggggatggcaggttttaccattcagctggagtacaaaccctgaaccctttttggttaaatatctacttgcttttcctacagtattattttgagttgctgtggctgtaatgtcttgagggaatcgagcttgacagtaatttatagaacaaacagtttttagagactgtgtggcccaattgccctctcaatgttggcactcctgccatgacatttaccatgctgagcatgtgaccgccatctgaataccaaatgccacaggaacctgggaggttgtcacttactcctccctttctctgagtcacctttgcccttcagtcagtcaccaagtcccatcacatgtagctctgtaatgtcacagaagatggatgtctgcctcaaaacacttacaatgctgctacctaaattgggcagccacgacctcccaccaggattattgcagcctgagggatctttttgaaatgtaaatcaaactatcacttgtctgtttaaagcttttcaaagacttaccccattgcccttggaagaaagtgcagatatcttgacaggagagccttctccagcctcctcttctgccgtggtctccttgtacagtctctacagtgtactgcttcattagaaccctggagattattatttgctagttctgggctaagaactggcacctggctttgtagagctcctcaggagattctgaggcgtattcagagttgagccctgatctctgctctgatttcgaggttctcgttatatttattaatgatcacgaaaaaatttattattattctttggcctcactttagcatcatctgaggaatttttttttttttttgacagagttttgctcttgttgcccaggctggagtgcaatggcgtgatctcagctcactgcaacctccgcctcccgggttcaagagattctcctgcctcagcctcccaagtagctgaaattacaggcatccaccaccatgcctgctaatgtttttgtattttttagtagaggtgggctttcacagtgttggtcaggctggttttgaactcctgacgtcagctgatccacccacctaggccccccagagtgctgggattacaggtgtgagccaccgtgcccagccgtagctttcgaaatttgaaacctggtcccactgtcagaggttccaatttggcactggtttggttcccaggcatctttcttgctgtatatattttttagtgtcagccagggtggagacctctgtattacttcatggggaagaatttgggagaagatgttgtgaggagacaggttctagtcctagagtgatttatcctttctcgtacagatttccaggtatttgaggggccactcttctgtaattcatgtttttctctcctaacctcactcctgttgcctgcatcttcttgctgagcaaaatattcaaggtcttcaactcctcacaccctggttgtccctccctggatgtgtttggttgttttagtgttccatttcaattttgatacacagaattagaatagcatccagatgtgggtctgttacagctagactactagatccttcaaaatccaagtactagtatgtctattaaaataccataagatcacattggctagttacaatggttggtttgtgggttacttaaaaatcaactaaaattctttttttttttttgagatggagttttgctcttgttgcctaggctggaatgcaatgacacaatcttggctcactgccacctctgcctcccaggttcaagcaattcccctgccttagcctcctgagtagctgggattacaggcatgtgccaccatggccagctaattctgtatttttagtagagatgaggtttttccatgttggtcaggctggtctcgaactcccgacctcaggtgatccacctgcctcagcctcccaaagtgctgggattacaggcgtgagccactgagcctggccaaaattcccactttctaatactcctgtagtagctgggtacggtgggtcacatctgtaatcccagcacttttggaggctgaggctggaggatcgcttgagcctaggagttcgagaccagcctgggcaagatggccagacgccatctctaatttaaaaaaaagaaaaaacaagactcctatagtggtgaagaacagacattccgaaaacagactgtgcgttatgattccagctccatgcctttactacctgtgttgtgactttggataaatcacttaaaaatcttttttttttttttttttttttgagacggagtcttgctctgccgcccaggctggagtgcagtggcgcgatctcggctcactgcaagctctgcctcccaggttcacaccattctcctgcctcagcctcccaagtagctgggactgcaggtgcccgccactacacctggctaattttttgtatttttagtagagacggggtttcaccgtgttagccaggatggtctcgatctcctgtcctcgtgatccacccgcctcagcctctcaaagtgttgggattacaggcgtgagccaccgcacccggccaaatcacttaaaattctgtgcctcagtttctcctctgtaaagtgggataaaaatagtacctatctgatagggttgttacaattatgaaatgagcaaataagtatgtcaagtgtttaaaacagcgcctggcttcttgtaaaaagtgctatataaatcatagctataatcattacttatttcgactgctctttaaccaaggttcttatttttcatctttttcttttgttttgaatatcacttagtgttttcaccttttactctttttaggacctagagccatcctaggtgaaatacgtatggagatatttgatcaggtcaccacccagctctcctgacctcccttctctccttaaattaacatgccaaatcacagcatcactgactccttccctcccgatatgataagagtgtgcattgaaatgcatgtattttacttagcagggaaagctgattagtgattatcacacttaacccctagtgaatctgatggattaacctgctttccaggacactaaggaaatgggtttaagataagaaatatctggctgggtgcggtggctttacgcctgtaatcccagcactttgggaggccgaggtgggcagatcacgaggtcaggtgattgagatcatcctggctaacacgatgaaaccccctctttactaaaaatacaaaaaattagccgggtgtggtggcgggcgcctggagtcccagctactcgggaggctgaggcaagagaatggtgtgaacccaggaggcagagcttgcagtgagctgagattgtgcccaccgcattccagcctgggcaacagagtgagactacatctcaaaaaaaaaaaaaaaaaaagtaagaaatgtccatgaaagggagaccctgggggaaaggaacaataactgcagctctgaggatctggcaccagcagcaccagcacagagggatgctgtacaaccattattgattttaactttacaacagttcttcaaaggagagagagttccctgttttactgaagagaaagcccatttggtagtgaaataccattcccaaagacaaatagctaataaatgtcaggcagggttttgcacccaggcccatccagctcccgtctctactgtcctttcccccacaccacactgatacagaggaatgtgtctggttggggaagtggaagtgttcccaagtggggaggtcatctgatgcacaaatttggtctgttttgtgggttttcttgttttagttttagtttttgtagagctcagacctgttcttaggcagctttaacaatcaactgtgcactcagtaattgacaaatcatgtttgttacttttaatttagagggaattaggtttgttaagctcttgctccttctttagagatggggtctagctctgtcacccaggctggagcgcagtggtatgatcacagctcactgcagtctcaatctgctcaagtgatcctcctgcctcagcctccatgggactacaagcatgggccaccatgctaggctaattttaaaaaaatttttttgtagaggcaaggtctcacggtgttgcccaggctggtcttgaactcctgagctcaagcaatccctcttccaccttggcctctcaaagtgctagaattataggcatgagccaccatgcctggcctttacttctttcatatattcaaattttgtcatattagtagggaactataactcaagttttcttatagattgatgttcatttttacaagcttgatcgtcattggtttttaattttaaagcaaatcctgttatatgtaattgaacattacagtaattatagtaatttgtttcagattgggcactcaagtgttaatattttgtctctttaggaaatcaaaactagatttatatatagacttcttattgcaagtatctagtcttaaatcttacaaaggtactatttggacttaaaactatgaaattgtgtgcttactatataagtgtacttattttgagttatgttttaaacttgaaattccattcttaatgtctagagtaattatgaatggttaaattatgaatgactctaatagtttaaagctacagtatttatttatttatttatttaatttattttttgagatggagtttcgctcttgtcgcccaggctggagtgtagtggcaccatcttggttcactgcaacctctgcctcgcgggttcaagtgattctcctgcctcagcctcccaagtggctgggattacaggtgtatttcaccatgcctggctaatttttgtatttttagtagagacaggcttttgccatgttagcctggctggtctcgaactcctgacctcaggtgacctaccctcctcagcctcccaaggattacaagcatgagccaccacacctggcctacagtattttaatgtggactctctgtcatccattatgctgtttatcctgtggtgaaaattttatgaagattgaatgtttttctctagcgtgaattgctttctcttacttttctcatttttttccttcctaatctacttgcagatacttcagattatttttagaacgtggtatggtgagaacaaataaattggggtttccaaatcttaataaattatgtggccctcagtgggattagcagggttgtattgaaaacaccaatagaaacaaaatagttcttttatgcgctttaaataaaaatttcttttcaggccaggcgcagtggctcacacctgtaatcccagcaccctgggaggctgaggcaggcagatcacctcaggtcaggagtttaagacaagcctggccaacatggtgaagcgccgtctctactaaaaatacaaaaattagccgggtatgatggcgcatgcctgtaatcccagctactccagaggctgaggcatgagaatcacttgaactcaggagatggaggttgcagtgagctgagatggtgccactgcactctagcctgggcaacagagtgagattctgtctcaaacaacaacaacaacaataacaaaacatctcttttcaggccaggtactgtggctcacgcctgtaatcccagcactttgggaggccaaaacaggagggtcgcttgagaccaggagtttgagaccagcttgggcagctggtctctatttgaacaaacaaacaaacaaacacaatactcttttcatagaaaaatgtttactacacaataaactttaaaagaatatgcagctgtattaatgctatgactccaatgtaaaaaaaaaaaaatatatatatatatatacacacacacaaacacattctgaaatagatttaaaggaattacatcaacatgtcaatttttattttttcggagacagggtctcgctgtgtcacccaagctggagtacagtggtgcaatcacagctcactgcagccttgacttcctggcctcaagtgatcctcccccctcagcctcccaaagtgctggggtcacagaccaccacacctggcaacatgtcagtttttgttctgcatagtgggatggtgggatatggatgtttttatcttttattttcttttttatatttttctaaattttccacattgaacattattttataatctttcaaacatatctcttaaaaggactggttcctatagaattcagtgcaagaaatcttctgtgtttctttatactttggttgccttgatcactgggcctttcctgacagcaaagaagaggttagtgtaggcagcagataaaacacaggtatgctctatttaaaatgcatgtatttataataaaagtataggtggtacccaaaggaaaatgtcatgacacattgcaaagtggaacagaagttatctttagatcactttctgttctggattattgtatgagcctgattttcgtctctctttccgccttccctcaccctcgttgtaaatccactagtgcatggatgtgaagtacaagtcttaactttaaaaagttttatgaagctgtgtagtaaatcccttttgtaagtggtcttgactgcgtttctcaatatatcttttggtttcattagattcaagtatataaatgagaactgtaactttggacagactttttcagtcatctttacggtaataagttcccaattagacaatagttatttgttttatgacttgctgttggtaggttatccccaagggactgagaaattcctgttttgaaaagtccaaaaagtctttgatgacttgctgtttcatttttttcttttctcttcagttatagaaaacaggattacacccaccttgcctttgtacagtgcatctactatctgctgacttaacctgagtaaatgctttgaattgagccccatataatgtcctaaggcagcctatatggagtaatgaattgtcttctctcttatgcacccagagtggtagttggcactcaagttgttcctcagataactttgtgtgttctggggctcaatgaagtagttattaagtcacaggcttggggagaacattcatcctatggcattgaatgaagtgttgcccaattctagaatgtctaataaaatttttttaaaaacccacaggcttagaattattccgtagatatgaagtaatgtagttagaacttagtggagttctttagattaacttgtaatttgaaaaaccaaaattgaaattgtgaaataacatgggctctttgaggtcttttccagtaaaacagttacagtaaagctgcttggcagtgattttcctagacactttggctagtcatctcctgtgactgctgttaattaaatatggtttgtagctaagcagcctgtaaggagaagactatggaagtatttgcatattctctccttgaaaatactacctggtctttggctttaagttatacttttattttcccctgtagaataactattaaagtattacctatggtgattagactaagaagtaaaacatgaaatcagtcattgttggtgccctggtgccttcttttttttttttttgagacagagtctcactctgttgcccaggctggagtgcaatggcacgatcttggctcactgcaacctctgcctcccaggttcaagcgattctcctgcctcagcctcccaagtagctgagactacaggcgcccaccaccacgcctggctaatttttgaatttttagtagagacagggtttcactatattggctaggctggtctcaaactcctgaccttgtgatccgcccacctcagcctcccaaagtgctgggattataggtgttagccactgtgcccagcctggtgctttaattttatggaaaaaactactagctggtttctgttttaagaaataacacaggccgggtgccatgacttgcgcttgtactcccagcagtttgggaggccgaggcgggcggatcacgaggtcaggagtttgagaccagcctggccaacatagtgaaaccccgtctctactaaaaatacaaaaattagccgggcgtggtggggcatgcctgtagtcccagctactcgggaggctgaggcaggagaatcgcttgaacctgggaggtggaggctgcagtgagccaagatcgccccactgcacaccagcccgggtgacagtatttcatctcaaaaaaaaaaaaaaaaaaaagaacacaattattgtactacttactagccctcctctgtccccagctaaaaataagaacagcaacaaccaaaaaatccttagttatgtactggaaatgaattagataattttcaataacttacacgtttttaggatatgttagtttgaaaatgcaaatattcatgcatgaccccagtgttaatctatgatggagcaggtatagtgggatgctgtttcatgatttaatttggaccttcagggagtagactgtgatgcctctgcatttgtatccaagacaaataattaaatagtctatttttggctgggcatgatgcctcatgcctgcagtcccagcactttgggaggctgaggtgggaggatcgcttgaggccaggagttcaagatcagtctgggcaacaaaatgagaccttgtctctacaaaaactacaaaaaattagctgaacattgtggcttgtgcccctagtcccagctactcaggtccctgagttaggaggattgcttgagcccaggagttggaggttacagtgatctatatttgccactgcactccagcctgggtgacagagagagaccctgtctcaaaaaataaagtctgtttttaaaattaattttaaacactggagtttattacaaaaagcagttggttctttttttaaatcatttttttttaggagaaccaccgctttttggctacattgtctagagtagcagtgttcaataaaaataagatccaagtcacatatgtaatgttaagttttcttttagtttctttttcttttcttttcttttctcttctttctttctttctttcttttttttttttttgatatgcagtctcactctgttgcccaggctggagtgcagtggcacgatctcggcccactgcaacctccgcctcccgggttcaagcaattctcctgcctcagcctcccgagtagctgggactacaggcatgtgccaccatacccagctaatttttgtatttttagtagagatggagctttgccatgttggccagtctggtctcaaactcctgacctcgggtgatccacatgctttggcctccctaagtgctgggattacaggcatgagccaccatgccctaccaatgttaagttttctagtagccatattaaaagaagtaaaaagaaatgggtgaagttaattttaataatatattttatttaacccaatatatctaaaatattatcatttcaacatgaacaagatactttacattcttttgtttttcactaagtcctcaaaatccagtgtgtattttatattgacagcatagttcagtttgaagcagccacatttcaagtgctcagtagccacatgtggctagtgactccatactggactgtgtaggtttagagtttcagtaaatttgtatgcaatagaatctacataaattggcatattatgcagatttctttgtatgcacatcagttcttgcatagcataagtcaggtcatgatgcttttagtctatgaggcagatttttttttttttttttttgagacagagtctcacttggtcacccaggctggagtgtagatgcacaatcttggctcactgcaacctccatgtgaggcagattttaacttggccctaatgcaaatattgtaagagagatctaatggcctttgatttcttacagagggcaatcaatacatgccatggttacaatgcttcagcatatagtatgcacgtcagccactgcttttactctggctagtgcttagtgtacctgtaccactgcccaggcagcatttgtcctgtggcaggtgaatcttagggtggaaggtggcaagtaacattgcttttttttgagagggagtcttgctgtattgcccaggctggagtgcagtggtgcgatctcggctcactacaacctccacctcccgggttcaagtgattctcctgcctcagcctcctgagtagctgggattacagacggccaccaccatgctcggctaatttttgtatttttagtagagacggggtttcactatgttggccaggctggtctcgaactcctgacctcgtgatccacccgcctcggcctcccaaagttctgggattacaggtgtgagccaccgtgcccagcctacatttttaaattaattaattataagcaggatctcactgtgttggccagactggtcttgaactgataagagttcaagaccagcctaggcaacatggtaaaaccctgtctactaaaaaatacaaaaaaaaaaattagctgggcatggtggtgcgtgcctataatcccagctacttgggaggctgaggcaggaaaatcgcttgaacccgggagactgaagttgcagtgaggtgagattgcaccactgcactccagcctaggcgattccatctcaaaaacaataacaacaaaataacattgttggaatatttagttaatttatagaagcgtattggcctaattggggcaaataccttattctgacattctctctatttgctttactgagctttttcaccagtggaatttaagcccttgatacatgaggagggaaaataccttggagctgtgctgcacatgtaaagtacacaggagatttagaaaacttcgtagcaaaaaaaagagtgtaaagtatctcattaatagtttttgtgggctggacacggtggctcaagcctatactcttggcacattgggaggctgagatgcatgagtctaggagtttgagaccagcctgggcaacacagtaggaccccgtctctacaaaaataatcagccagatgtggtgcgcatctgtagtcccagttacttgagaggctgaggtgggaggatcgtttgagctgggaagttgaggctacagtgagctgtgattgaaccactgcactccagcctgggtgacagagtgcctgtctccaaaaaataaataaataaataataatatgttttgtatgttcatatgttgcaataacattttggatatattaaatgaaataaaatacattaaaattaatttcacctgtttcttttcttttcttttttttttttttttttgagatggagtctcgctatgtcatcaggctggagtgcagtggcacgatctcggctcactgcaacctcctcctcctgggttcaagcgattcttctgcctcagcctccctagtagctgggattaaaggcatgtgccaccacacccagctaatttttgtatttttagtagagacggggtttcaccatattggccaggatggtctcgatctcctgacctcatgatccgcctgccttggcctcccaaagttctgggattacaggcgtgagccactgcacccagcctcttttaactttttaagtatggctaccagaaaatttaaaatgcatgtgtggcctgtattctatttctgttggatgctgctgccttagattattaattattcaatgtaaagactgctgggaggtactacctgcacttccctgaatatatgcttgagagctccaccagccgtcttcacagtagcaagaggggtattctgagtctgtcccccaaagagggagggagaagtgcagccctctcaggttctgtcagaaaacctgatcccaggccaggcgtggtagcttacgcctgtaatcccagcactttgggaggttgaggcaggaggattgcttaagcccaggagttcgagaccagcctgggcaacacagtgaagaccctatctctacaaaaatttttttaaaaaaattagccaggtgcagcaatgctgcctgtactcccagctgcttgggaggctgaggtaggaggattgcctgagcccaggagttagaggttgcaggagttagaggttccacgatcgcacctttcattccgttacatttgctgccttgagaacagaagacctgctggttttgttgccagtttgctcagtcatttttatgaaaaagccagtgctaactaggtgcttcttcgtgccttctctgagaatcaagaactctagtatgtttgcgtgtgttcagtctctcattaaatgttctcactatcccagagaaccatctcattggaccttggtctgtacataccttcatctttggctctgacttgtaattatttttagaacttctctttttttttttttggagacagagttttgctctagttgccagactggaatgcagtggcacgatctcagctcacctcaacctctgccttccaggttcaagcaattctcctgcctcaacctcttgagtagctgtaattacaggcatgtgccaccacgcctggctaattttgtgtttttagtagagacagggtttctccaagttggtcaggctggtctcaaactcccgacctcaggtgatctgcccgccttggcctcccaaagtgctgggattacaggcgtaagccactgcgcctggcctaattttagaacttgttaaaacaacttggcctctattgatatttccatgacccatgctattcagaaagaggattacaggtaattagctggctgggtttctcataccagagcatttcactgggatgttcctgaacctgggacaacttttatgcctggcatttttctttccttctctgttgtcccagactaagcaatttttaaaatagttattatttgttgagtaggagaatctcaggcagatcttcctggatcctcatttatacttttaaacctgtagtcttggaattagtgctctgtcccccaaccccaaacatccaatttctacattttggctacagtacaggtttactgtgtataactaaaagggctgtggaggagaaagaaaggaaccgacatttgttgggcatctgttatgtgccatgcactgagctggatgctgtaggaatatctcaatacctctgaggagtgggaattattatctctattttatagacaagggaatagaaatctgggagttaagtaattttttaatttcacacacttctggtagataatggattctagaacctggcataatagccacttgtcatcccagtgtaaaagagatgtgtggccagatggggtggctcacatatgtaatcccagcactttgggaagccgaggcaggaggatgacttgagcccaggagttcaagaccagcctgggcatgttttgtttgtctcacgaaacattttttaaaaaatgagtgtggcatggtgttgtgtgcctatagtcccagctcctcgggaggctgaggtgggaggatctcttgagcccatgatcatgccattgcactctagcctgggccacagagcaagactctgtcttcaaaaaataataaaaaggagctgtgattatcccaaggtggggattgtgaatgtgtttgtattgttctaaactgggagaaacaggctgggtgtgttggcttatgcctgtaatctcagcactttgggaggccaaggtgggaggatcacttgagtccaggagttcaaggccaccctgggcaacaggcaaaaaatagagaccccatctctattttttaaaaataaaataaactgggagaaagaagcagggtcctccccagagcatctttatccctagtcacagacctgacacctgtgttgggcaatggctacttctagattgtttacccctactgggacttgtggtgaacatatgcacactttggtttacagttgggacccctgattttagcaggatggcccaatggaatcagctacagcagcttgacacacggtacctggagcagctccatcagctctacagtgacagcttcccaatggagctgcggcagtttctggccccttggattgagagtcaagattggtaagtccttcttaagtgactctccaaattgttaggtttcagtttgagtcaagagacatgaactcttaatgtcatgccttgctgttccattaaaaaatgtatgggtacaggtgatggggaaaatgagatcaggagataaaggggcaccctttggtcttgtaaagccttttttatcttagaagggcatgtgggcaactgtctttgacacattgaaaccgcctgtatggtggtggatgtcttgaaggttgatttggacctcatttacttgggcagatcctctatatattctgataatccagtgatgtggtagacatattttttctctgaatgtgaattctgtcatagctagaactttgggttgatacttgtaattcccctttagttaaaggaaggagccacaggggtgtattagtctgttctcaatttgctataaagaaatacctgagactgggtaatttataagaaaagaggtttaatcggctcatagttctgcaggctatataggaagcatagcagcatctgctgctggggaggcctcagcaagcttccaatcatggcggaaggcagagagggagcaggcaggtcacatggccacagcaagagcaagagagcaagggggaggtgccacacacttttaaactatcagatctcacaagaactcactgtctcgaggacagtatcaacagggatggtattaaaccattcatgagaaacccacccccatgatccagtcaccttccaccaggccccacctcaaacagtgggggttacatttcagtatgagatttgggcagggatgtagatccaaactagatcacaggataagggaagtagattccattcatagagcagataatggcacagatgtccagcaactattttcttcactttaatatgctcaggctcactactgattttggtttaattcaggccagtgttaatatgacctggtttttccagaatgcatactctgatttggtgaagggccaggaggtgattcacagatgttggagataggccatcccagcctgggattacttatttgtactaataaatctgaccagagttaattgagggtttaaagcaaaacagcatatctgtctactttgctcaaatattttacaaatacaacagattatgagagtgggtaataatatctggaataattgtttttttgttttgtggtttttttttttttttttttgagatggagtctggctgtagcccaggctggagtgcagtggtacagtctcggctcactgcacctctgcctcttggattcaagcgattctcccgcctcagcctcccgagtagctgggattacaggtgcccaccaccacacctggctaattttttatttttagtagagacagcgtttcaccatgttggccaggttggtctggaactcctgacctcaggtgatccgcctgcctcagcctcccaaagtgctgggattacaggcatgagccaccatgcctggcctggaataattgttaataattattacattgatggcattttattgctgagcaagaagaatctaacatgatgaatgggttatagcatcaggtttgctttgtttttttgtttttttcctctttcttgatggtgatttctgtgtttgtgtgtatgcgtcggcttcagagccattctttatcattcttccttttcctagggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcaggtatgatgagaaactgaggacaaggagaaacaggacccgcagagtcgggtgttagtgttctttcctggaagcatctcttttctcatttggctaagtaacgagaatctatcttgtattttcaatcacaggagaagtaattagccctttctcaaagctctgtatacttacccgtgagcatcattacctgagaatcacttctcttgtcacagttgaagtaataaagtgattgttatgttaatcatacatgttagcatgttaacgcggtccactgataggaagatgactctcactgttacatgttaaatgtttgaccataatgggatacttcttgactaagtcagtagcttccctgcaagaccaggatagtatactgtgtaaagactcagacaaggccaggcatggtggctcacgcctgtaatcccaacaccttaggaggttgaggtgggaggattgcttgagcctgggagttttgagaccagcttgggcaacataacaagacaccatctctacagaaattttttttaaaaactagctgattgtggtggcatgcacctgtagtcccagctactcagaaggctgaggtgagaaaattgtttgagcctgggaggtcgaagctgcaataagccgtgattgcgccactgcactccagcctggcggacagagtgagagccagtctcaaaaaaaaaaaaaaaagactcaggctaatgtgccttctgttacagaaatagtaacgacctccccttcgccccccgccgacagagagccttcacccaggctctgaagcctttgttccgttgtttcctagaataaatgctttccttgatgaatacattagttttaaggtgccacagttcagtccacatctccatggtctgctgctgatttttattctctttctctcctacttatagagcaggtatcttgagaagccaatggagattgcccggattgtggcccggtgcctgtgggaagaatcacgccttctacagactgcagccactgcggcccaggtgagacctgagacaaaacaaatccctggtctgggaggaatggaaaatcaaacaactttataatgagataaattattagatctactaaaaaagaaggaaaagaaattaaatagatcaataatcataaaaatacattgaaaaactctaaaaaaaaagaaagttccaccccccaaaatacattgaaaaactctaaaaaaaagaaagttccaccaaaagaatccaacagacccaatggtttaaaagttttgttttgttctgacaaattttctttgtttttctttttttttttttctgagacagagttttgctcttgttacccaggctagagtgcaatggcgcgatcttggctcactgcaacctccacctccagggttcaagtgattctcctgcctcagcctcaagagtagctgggattataggcgtgtgccaccacacccagctaattttgtatttttagtagagacggggtttcttcatgttggtcaggctggtctcgaactcctgacctcaggtgatccgcccgcctcagcctcccacagtgctgggattacaggcgtgagccactgtgcccggcctgttctgacaaactttcatagtacagattattccaatatcattcaaacttttccaaagtataggaaaacaagggatgttttcagcttattttatgaggctggaaaaatcctcatatcaaaacctaaaaaacagccaggtgtagtagctcacgcctgtaatcccagcactttgggaggctgagacgggcagattgcctgagcctcaggagttcgagaccagctggggcaatgtagcgagacctcatctctctttttttttttttttgagacagagtctctctctgtcgtccaggctggagtgcagtggtgccatcttagctcactgcaacctccgcctcccaggttcaagcgattctcttgcctcagcctcccgactagctgggactacaggtgtgtgccaccaagcctggctaattttttgtattttttttagtagagatggggtttcaccttgttaggcaggatggtcttgatctcctgacttcatgatccaccggccacagcctcccaaagtgctgggattataggcatgagccaccacgcccagccttttttttttttttgagacagagtcttgctctgttgccaggctggagtgcagtggcgtgatctcagctcactgcaacttctgcctcccaggttcaagctattcccctgcctcagcctcccaagtagctgggactacaggcgcgcgccaccacacccagctaattttttgtgtttttagtagagatggggtttcactgtgttagccaggatggtctcgatctcttgacctcgtgatccgcccgcctcggcctcccaaagtgctgggattacaggcgtgagcaaccgcacctggcttaattaaggatctttctaaacacaagaaagaatatttatcagaaaccaaagggagcatgatgcacagtggtgaaacactattctcagtaaaaacagcaaaagataaggatgtcttttaccattgatacttttctgagggatccagcctatgcaaaaagaaaaagaaatgagggtacaaatattggaaagcaagggacagaactcttattatttacagatagataggtcttcctcgaagatccaagagaaacaaaactaacaataacaattggaactagcaaggtttagaaaggccattgtatacaagataaatatttttagaatctgcagttcccctaatcagtagcagcagtaacctgttagaagatgtaatgaaagtaaagatctgggccaggcacgatgtctcacgcctgtaatccaagcactttgggaggccaaggtgggcagatcatgaggtcaagagattgagaccatcctggccaacatgatgaaaccccatctctactaaaaatacaaaaattagctgggtgtggtggtacgcgcctgtagtcccagctactcgggaagctggggcaggagaatcgcttgaacctgggaggcggaggttgtagtgaaccaagattgcgccactgcactcctgggcgacagagcgagactccgactgaaaaaaaaaaaaaaaaaaaaagaaagatctgattcatagtagtaaaactaaatgtatgcaatttgcatatactattggtatgtatgggaaaatatctggaaacacatatactaaatcattaaagtagtcggtcataggagacttttttactttctgtgaggggttttaccgtctttaatatcctataatcagggacattttttctttttctccgtgaccccctgctttttaaaaaattgtggtgaaatacacataacattacatttcaaatttacctttgtaacctttgttttttttttttttttttgagacagtctcactctgtcacccaggctggagtgcagtggtgtgatcacagctcactgcagcctcaaccacctgggccctagcgatcctcctgcctcagccttatgagtagctgggactacaggcacatgccaccatgcccagctaattttttttttttttttttttggtagagatgggctcttgccatgtttcccaggctggtgttgaactcctgggctcatcaactgatgagaaagagctctccaggcagaaagaagatcatgttcaaagacagaaacagaaatgtgtattcttgggagaagtgtagaaagttcagcatctgattgggtcggggaagacaagctagtcaaggccacatgatgttttaattagtcatgcctaacagtggggccctggaagagcagtttaccacaaggggccaactgcttcggtttgaacccgcagccctgccacttgctctgtaaccttaagtaaacaatttttactctctctgttcctccaatgggagtgataacaataccttcttcatagaattaattcatacatgtaaaatgcttagaacagtatctgacacataaatgcaaaataatttaactgctttctgctgctgctgacatcactatcatcaccctcaccattactgtaggaaatggggacccagtgaagaattttttttttttcttttgagacagagtctcactctgtcacccaggccggagtgcagtgacgcgatttcggcccactgcaacctctgcctctcaggttcaagcgattctcatgtctcagcttcccaagtagctgggattacaggcatgagccaccacactgggctaattttttgtatttttagtgagatagggtttcaccatattggccaggctggtctcaaactcctgacctcaggtgatccatccacctcggcctcccaaagtgctgggattacaggcataagccactgtgtccggccctagtgaggaattttaagcagaaaactgatatgctcaggtgtgagcgaggtggtaggtaacacttactgtgcagtgccctgtagcccaagaggttagcacacaggcatttgctcaggcagcactaggattttctgctgtggaaaacctttgtattttatcctgctccacaagataaaaataagtggtttaagtcaatttggatagaggctccaacttaccatgggaggtaggaaagccaaagttatcccaaggatgttttcaatcgtacggattaggggtctgcaaactgtgagcgtggcccaaatccagcctgctgcttgtttttgtaaatgaggttttttcggaacccagccacactcatttatttatgcattatctgtggctgctttggtgctgcagtggcagggctatttgtggcagggactgtatgacccaggaaaccaaaaatatttaccctctgtcccttagagaaaaagtttgcaacccctgatataaagctataagttggttatttgtggcctcaacccaggcctcactgctattttttctgtttacaatacctggcatgctcttaagtgtctagaattggttaaagatagaagagtggatgtaatccctgctaccaagggctgtcaggctagttgggattataagtacacaaacactcaaagtgagaaaaacacagaaaaggatgtgtgtcattttgtctaaggaagttgaataagatttctcaggaaaagaaacatttgaactgaatttgaaggtgagtgagttcaggtgtgtttgggctgaagcccaggccatgctgagtggatagcgggtgggaagagagtgtggaaacacactgcatgcagggaagagttgggagtctggggtgaccaaggcacagggagggaaagttgaagttatcaattgtgtgaaacagctttctgtgttggcctgagatgtttatagctggaagcagtggggagccaatacagttttttacgaaggtattagaggtgggtttctgtgggtgatcgttaatcatgttttctccctttaagtgtagtcctgcttgagaaatagacatgagaaaggaatgaaggttaaaacatcagctgtattgttggtaaaactagaatggaaagtgtggcttgagctggtaaccataggggctttccaatgcctgtgccctgagttagatcttggggtagagagactggatgtgcagagcagcacccccaccccaccccagccatccatatggagcttcagctgccatagaccaacaaggcagagggataggcctctagacctgcttctagaaaccaggctgctgctcttgcttatggtgggccctaggaaggcaagagtgagaggagggaggcaccagcttaggtgctgggttctttgaagatctgtgtgtacacagagtctttctctccatcttaccaatcagatgagtcactgtcactgtgggaagaagtaggggcatgggtcaccttcccaaaacttctaagaagtttgtattctgtgggcttggatagggaccatgggaaaggaagagaatggttgcccataaaactggctgtagtgtggcctcaaacttctggacttaaatgatcctcccacctcagcctcccaagtagctagaactacaggtatatgccaccatgcccagctagttaaaaaaaaatttttttttttttttggttgagatgaggtctctttctatgttccctgggccggtctcaaactcccagcctcaagtgatcctcctgccttggtttcccaaagtgctaggattataggtgggagctaccatgcctagcccaagcctgtaattttttttttttttttttgagatggagtttcacttttgttgctcaggctggagtgcatggcgcagtcttggctcaccacaacctccacctcccgggttcaggcgattctccttcctcagcctcccgagtagctgggattacaggcatgcaccaccaagctcagctaactttgtatttttagtagagatgggtttctccgtgtcggtcaggctggtctcaaactcctgacctcaggtaatctgcccaccttggcctcccaaagtgctgggattacaggcatcagccaccgcacctggcacgaacctgtaatttttaagtttcatatgctatttattttttgttatttctttaattcattcattcatttattcattcgagatggggcctcactatgttgactaggctagttttgaactcctggcctcaagcagtcctcccacttcagccttcccaagtgctgatattataggtgtgagctgctacatccagccttctttcttctttttctttttccatgtgctatttgacattttccaaggtaccagcctccccttctccccaagataatatcttttaatatggaatttcatccctagggcaggactttttttttattatccctcagaaatatactggacaccacgtttaagtagacatccaacatctgctgtcataaattgttttgaattttttgacatacttgcccatgaggtttttgaaggcatagaccatgtcttagctgaacatgtggtctcttagtgccataaagggggtttatggtatgacctgtgtagtgtcacctgtgtagtgacagcaccactgcctctgtttcccttcctcttgtgatggcagcagcgtctcaagccaaacaagaagggtagttagggtgggatggaagctgggtagaggtattcctctccccatagttctgtgttcacatgtgcattgacctcctttttggcagcaagggggccaggccaaccaccccacagcagccgtggtgacggagaagcagcagatgctggagcagcaccttcaggatgtccggaagagagtgcaggtgatgcaagttacaagcctcgggcagggagctttcattaatttttttttttttttttgagacagggtcttgctctgccactcaggctgggctgcagtggcatgatcacagctcactgcagcctcgacctctcaggcccaagcgatcctcctacctcatcctcccaagtagccgggaccacaggcatgcaccaccacgcccagctaattaaaaaaaaaaaatttgtagagatgggggtctccctgtgttgtccaggctgatcatgaactcctgggctcaagtgatcctcccaactcagcctctcaaagtgctggcattacaggcgtgagccactgcacctggccaacagggagccttctcttggggatactgcctgcaggtcctgcatgtatcttttttgaggttttggcttcatttgaattctcctcagaaactttatattttctgttcccaaggaaatctttctttacttctgtttttttgtttgcttattttaaacaggatctagaacagaaaatgaaagtggtagagaatctccaggatgactttgatttcaactataaaaccctcaagagtcaaggaggcaagtgaatattagagatgttaaaatctctagaaagtgagtttgtgttgttgagttgaaagactcatttgtcttaactctgtttagatcttaaggcgggcggggcgcaagggaggtacgggtcctcaaaggagcctggtcattaaggacaggagtattccctcaggtccaggagtattccctcaggtccaggagtattccctcaggtcaaggagtattccctcaggtcaaggagtattccctcaggtccaggagtattccctcaggtccaggagtattccctcaggtccaggagtattccctcaggtccaggagtattccctcaggtccaggagtattccctcaggtcaaggagtattccctcaggtccaggagtattccctcaggtccaggagtattccctcaggtccaggagtattccctcaggtccaggagtattccctcaggtccaggagtattccctcaggtcaaggagtattccctcaggtccaggagtattccctcaggtccaggagtattccctcaggtccaggagtattccctcaggtcaaggagtattccctcaggtccaggagtattccctcaggtccaggagtattccctcaggtccaggagtattccctcaggtccaggagtattccctcaggtccaggagtattccctcaggtccaggagtattccctcaggtccaggagtattccctcaggtccaggagtattccctcaggtcaaggagtattccctcaggtccaggagtattccctcaggtccaggagtattccctcaggtccaggagtattccctcaggtcaaggagtattccctcaggtcaaggagtattccctcaggtcaaggagttttttcttccttcgcagacatgcaagatctgaatggaaacaaccagtcagtgaccaggcagaagatgcagcagctggaacagatgctcactgcgctggaccagatgcggagagtaagggcataggtcggaccacttcccccatgtgtctcgctcacttgcgggatttcagcgtcttgtggcagaacttgcttggtttctaagaagttcctgctctggagttgactaaagaatgtggttagagacagtctgaggaaatgttttctgactttgttttggtttccaaccagagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggtaaaggatgaaagaagcttttcctttctttctcgaaagctagattgaattctgatcttaactgcaggcccacagaattggtactatatctccaacgtggggacttttccatattcaaatttagcccaagaattaaagtttttactttatttcggccaggcgctgtggctcacacctgtaatcccagcactttgggagaccaagatgggcggatcacttgaggtcaggagtttgagaccagcctggccaacatggtgaaaacacatctctactaaaaacataaaaaaattagccgggcgtggtggtgcgcacctgtagtcccagctactctgggcggctgaggcaggagaatcacttgaacctgggatatggaagttgcagtgagcggagatcttactaccgcacaccaaccagcctgggagacagagtgagactccatctcaaaaaaataaaaataaaataaagtttttactttatttggagaaactttgttttaaaaaatgtatttatattattatattttaagtatattttacttaataattcaattaaggcttttggtttaactgtatttaacagatagacaaaccttttaattttagttattttagtaatctaaaatgacacatgccctttttaagggaaaaaattcaaatacagaaaattaatcaagagaagaaaaaatttttaaatgaaatcatcagcagtactagtagttaaaatttagttgatgctcaatctagacatctgtcattatgtatatacacattatgtatatacacataaagatagaaatttatacagtttatattaggatcatttttttttctttttttggagtcagggtctcactgtgttacccagtctagagtacagttatgcagtcatggctcactggagccttgacctcctgggctcaggcagtcttcccaccttagccttctcagtagctgggactacaggcatgcaccaccacacctggctaatttttaaattttttatagagacagggtcttactttgttgcctgggctggtctcaaattcctgggctcaagggatcatcccacttcggcctctcaaaagctctggaattatagatgtgagctgccgtgcccagcccaggatcttcctttatatgcttttctgtaatttgcacttttaccttcatccagcatatcttactgcaacccttcctgtgcaaggccctatagtgagcatgttgcaccagcttgccttaggagaaacttgagatacagagcctgcactggaaatttagcgcaactctacatgagaatgcctgtctattcatatcctcactaaccctgagtgttgttaatttactgaaagcagttttaaatgcttcctgaccagggaacgaagaagcttaagttctgggaatgggaggatagaagtgccagaaaagagctcaggagttcagaaatccctgcagcggtccccctccctctcctttcactttctgtctttctggtcttttggtctttgttacactagtgataaaccatcaaagaatgatggaatgatgctaacttctctctttttttaatttttttgagacagagtctcactctgtcacccaggttagagtgcagtggcatgatcttggcttactgcaacctcctcctcccaggttcaagcgattcttagtcacaaccttccaagtagctgggattacaggcccatgccaccatgcctggctatttttttgtattttagtagatcgacctgcctcggcctctcaaatttttgggattacaggtgtcagccactgcacctggcctaatatctctattcttggagatagatttaatgagctttttctccctctctattcacttattccttgtgcatgttatcaatattttgaaacataatgtcatgtcctttgatcagttgaaggctgacattgaaaaggcttatggggattgggtgttgtggctcacgcctgtaaatcccaatgctttgggaggcagagtcgggaggatcacttgaacccaggagtttgagaccagcctgggcaacaaagtgagatcccatccctacaaaaatttaaaaaactagacatgtgccattacacttcagcctgggtgacagagtgagactccatctcaaaaaactaaactaaactaaacaggcatggtggcacacacctatagttctagctactcaggaagctgaggtaggaggatcactcatgtccaggagttggaggaggcagtgagctatgatcatgccattgcactgcactaggccacagagtgggaccctgtctcaaaaaaaaaaaaagaaagaaagaaaagaaagggctcatgtagttcaagcccttctcttcatgcaaggggatgctaaggcccatgatggtgaagggcctggcaaagcttgcacagatagtgtgtgacagagctggctcaaacccatctttgggagctgtctaatctctttttctgagtctttatgttcatagacaagttaggatgagtaaagtaagtgctaaattccatatttcgtgttctgcatatctgggctcagatgcttgtcattttccagtgataactccatcaatgcctcctagtggtataaattttaatacttcttgtgtgcccagccccctcttagaaatttgagattttaggaagggactagtaataaaaggtaaaataaattattttctggccaggcatggtggctcacacctgtaatgccagtacttcgggaggtcgaggcagatggatcacctgaggtcaggagttcaagaccagcctggccaacaaggcaaaatcccatctctactaaaaatgcaaaaattatccgggagtggtggtgggtgcctgtaatcccagctacttgggaggctgaggcaggagaatcacttgaacttgggaggcggaggttgcagtgagctgagactgtgccactgcactccagcctgggcaacagagtaagactctatctcaaaaaaaaaaaaaaaaaaaaaaaggccaggcgcagtggcttacacctgtaatctctcaggaggctcaggcaggagaatcacttgaacccgggaaatggaggttgcagtgagccgagattgcaccactgcactccagctcaaaaaataaataaataaataaattattttctttttttatttattttttcagcatccacccaacatggtgaaaaattcctcttttcttaatgtcactgaactgtaaacttaagatgaaaaattgtaaatttcatgctatatatatttcaccacaataaaaaaattccttgttcttattgtagtggtctccatgtcttcagtatttccttccccttctccatctcacctgtatacattcactttggtaattagcatctttcttaatttattggcaggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaaggtaatttagcatccttgtccctttccctcatctaaaaaatacctaaagactcacgtggtagagtgagaggcgggctgacttctggtcatggccgtggcgcgtgagcccatcttctctttcctcagtgcctttgtggtggagcggcagccctgcatgcccatgcatcctgaccggcccctcgtcatcaagaccggcgtccagttcactactaaagtcaggtaggccatgccacttccatttccagtagagattttactgagggacactgttagggtgagggtagagttggtggccagggtcattctttccaggtgtggtgtcacaggcagtacactgttgcggggttgaaatttgttgccatactatctgcttgctctctgattctgatgtcaaaagcaaaagagcagtcatctttttgaaggtacctgggcatattcctatgattgtagacctggagtctcaggccacagcttctccttctgcccaagggacaaaataatgtcatctattttctgttctttgaggctactcttccctgtggattttaagggaaagagtaaggcttagtgatggggaagctgagaggccccagggcaggtgggtggtgggcctgtagggtgaggtgttactttcacactcaagtcagaacaggtgtgctggggttttgaccttctgcagcaaaatttccctcctcagaaacttagtatggtgttcggtttcaggattaatagaacaaaatgccagctgcacagcatgtgttcctgtaatatttttcattatatggctttgattatccttttgtgaatctctcacaactttaagttgttagttcttagatgttttctcagtacctttggcttgaaggagtgatactcatcttttgtttttgtttgagacagggtctcactctcacccaggctggtgtgcagtggcatgatctcagctcactgcaacctccatctcccaggttcaagtgattcttgtgcctcagcctcctgagtaactgggaatagaggtgcgtgccaccacacccggctaatttttttttttttgagacagagtctcgctctttcggccaggccagagtgcgtgttgcaatctcaactcactgcaacctccacctcccaggttcaagcgattctcctgccttagcctccctgagtagctggaccggcacactccaccatgcccggctaatttttgtatttttagtagagacagggtttctccatgttggccaggctggtctcaaaactcctgacctcagtaatccacccaccccggcctccaaaagtgctgggattacagatgtgagccaccacgctcggcctttttttttttttttttttttttgagatggagtctttctctatcacccaggctagagtgctgaggtgtgatctcggatcactgcagcctctgcctcctgggttcaagtgattctcctgcctcagcctcccaagtagctgggattacaggtacctgccaccatgcccggctgatttttgtatttttagtagagacggggtttcaccatcttggccaggctggtctcgaactcctgaccttgtgatccacctgccttggcctcccaaagtgctgggattacaggtgtgagtcaccgcacccagccctattttaatttttttaaagagagagataggggccaggcacggtggctctcgcctgtaatcccagcactttgggaggccaaggtgggtggatcacctgaggtcgggagttcgagaccatcctgaccaacatggagaaactctgtctctactaaaaatacaaaattagctgagcgtggtggcgcgcgcctgtaatcccagctacttgagaggctgaggcaggagaatcacttgaacccaggaggcggaggttgcggtgaacggagattgcgccattgcactccagcctgggtaacgagagaaactgtctcaaaaaaaaaaaaagagaaagagagataggatctcgctctgtcatctaggctagagtgcagtggcatgatcatagatcactgtagccttgaactcctgggcacaagtgatcctcttgcctcagcctcccgagtaactgcgactacaggtacatgctaccacaccccgctaatttttaaattttttatagatgtgggctctcactttgttgcccagactgttatggaactcctgggctcaagggatcctcccagcttggcctcccacagtgctgagattatagatgtgagcctgtaattatagacagcttggcctatttacctgttggaaatgaagaattatgaattttacatttcttcaagaaaaggttatgggagagttactgactttttttccttggattttttctttttaaataggttgctggtcaaattccctgagttgaattatcagcttaaaattaaagtgtgcattgacaagtaagtactcctatcttagctctgtttttcaaatgaggaatagaaaaatgagaactttgacagacatcatttgaactagagactctgtctttattcagagatcttcattttgtggacaaaagttttcaaaagccttggggtgcattgtcatttacgtgtctgaacaaagccacaaagctgggggtacagatttgatttgtggttgctattgtgacaaccagtccctcttttccttgtttagttttttacttgtacatgtcattcatgcatattatatataagactgagatcatgtgttaattaacgactgggatacgttctgcaaaatgtatcattaggcaattttgttgtgcaaatgttgtagagtatatagtccttacacaaacctgggtggcagaacctactgcacacctacgctatgtggcagagcctactggtcgtaggctgtaaacctgtacagtatgttactgtgctgaataccgtaggcaattgtaacacatctcaatgaagtaggaatttttcagctccatgataatcttatgggaccaccatcatatatgcattttgttgttgaccgaaacgtcgttatatattctttccatacatagcatgtggaaagaatagatctcttttttttaattgttccacactttaccatataatggaatacgcaaaatttcacaatacctttcaggatgtaaaatacatataccctttgacgacattagaaaagagaaaatgtgggccgggcgcggtggctcatgcctgtaatcccagcactttgggaggccgaggcgggcggatcacgaggtcaggagatcgagaccatcctgggtaacacggtgaaaccccgtctctactaaaaatacaaaaaaactagctgggcgtggtggcgggcacctgtagtcccagctactcaggaggctgaggcaggagaatggcatgaacctgggaggtggagtttgcagtgagccaagatcacaccactgcactccagcctgggcgacagagactccatctcaaaaaaaaaaaaaaagaaaagaaaagagaaaatgtggctgggcgcggtggctcacgcctgtaatctcagcactttgggaggctgaggtgggcagatcacctgaggtcgagagttcgaaaccagcccgaccaacatggagaaaccttgtctctactaaaaatacaaaattagccaggtgtgttggcgcatgcccgtaatcccagctacacgggaggctgaggcaggagaatcacttgaactcaggaggtggaggttgtggtgagccgagatcacaccattgcactccagcctgggcaacaagagcgaaactatctcaaaaaaaaaaaaagaaaaaagaaaagataaaatgcattcttatttttagttgatgtaattatgtggaaatttcatgaggatgcactggaaaataatgaaataagggagttgacgaaggtggtaggtttaataagtacatatgcaatatgaaacataggttccccttcctatggggaggcaaccaactgtgcctgctacgcagaggtgttatgttgcgctgatcaactgtaactgaatagtttaaagaaatgcccaggagcacagaggttttttcatgacagtaaataacaggtggtcaaagtaggctttttgaagaaacacagagcctattttattaacaacagtctgtgttcttacagagactctggggacgttgcagctctcagagggtaagttcagcctagaggcttccttttgttccgtttaacctaacttcatcctccggctacttggtcacctacatagttgattgttcccctgtgattcagatcccggaaatttaacattctgggcacaaacacaaaagtgatgaacatggaagaatccaacaacggcagcctctctgcagaattcaaacacttggtatgtgggaggagctccccttcacaaagggcctctggctgccggagagggctagggagagcctcacaggacacctgcctttttcttttcttacagaccctgagggagcagagatgtgggaatgggggccgagccaattgtgatgtaagttttgttggggatgaaagacaactggggtgttttccttgagggagagaggggtaaagatccttcttaatccccagaattagaaacatcaacctgttctttcagctgtagttattccaaaaagtcacttcaggccaaagtgacatgaacagaagttccatgtgccatggagctctctggcttggaacatttccgtgaatatctgggagttggctcctccttaaggagaagtggaaagtcccttgctgagttgttctccacacccatgtggtataaagcagctttccaccttgcctggggctttccaaattccccatccagctcctgcggctgaccctgcttggctccatttttagtgccctgtttttctctcccactgaggtgggatagagggtgtaaaagcaacagatttgagttaaactttaaaataaatgaccaccttgcattagcttgcttaggaaaagagtacataaaataaaatgaacaaacaaaaacccatcttgttctttatcccccttattttctgcttttcattgattcagattattggattcttattgtcaagaataaactttaaacaaacaaacaaaaaaaggtaaatgtgacggaaggctagttttcagtcatttttaaaaattgtgatgccccgttctttttcttacatttgtcccctgaacaattcttcctctttaaaatgtagcagtcctagctgggcgtgctggctcacaccccgtactttgggatgccaaggcaggctggtcacttgaggtcaggagttcaagaccagcctggccaacatggtgaaagcccgtctctactaaagatacaaaaattagctgggtgtggtggtgcacgcctgtagtcccagttactggggaggctgaggcatgagaatcgcttgaacctgagaggtggagcttgcagtgagccaagattttgccactgcactctagcctgggcaacagagtgaaactctgtctcaaaaaaataaataaaataaaatgtagcagtcctttttaaaaatgtggaattttacttgacagtagagtgaagtagcctgtatgcaatgatatgggaaaatgtacatgacatattaagaaaaagcaaaatgtaaaataatttgaatagtattattagtatatgtgttttaaaaatacactatactcttatgtgtattcatatgtatattaagaaattctggaggaatataccagcagtgctatgtgtattagtgctgctgttggtatccatggctattctagactgtctctgtgatatttgcattttaaactgaatatattacttttataatcagaaaaatagtattaaaaatgaattataatttaatttcttttttcttttttttttttgagtcggagtctcgttctatcggattgcagtggtgcgatctcagctcactgcaacctctgcctcctaggttcaagcgattctcctgtctcagcctcccaagtagctgggacgataggtgcatgccaccacgcctggctaatttttgcatttttagtagagacagggtttcaccatattggtcaggctggtcttgaactcctgacctcgtgatccacccatctcggcctccgaaagtgctgggattacaggcatgagccgctgtgcccagactagaattcaatttttgagaattcattgacaactcttacttaaaataaggttgctgtactgatgtgagacattgttgtagtcagtttggaaaacaatttggcagtataaaaatgaacatacctgtaaaccaacggtgccattcccaggatttaatagcagagaaatctttgcatatatgtcccaggagacatatataaagtggacatcagcctgattataagctctaaatgcaacccaaataaatacccatcaacattagaatgaatacattatttgtggtatagacacaatggaatactccgcagctgtgaaaaggaatacactgcagatacacataaccatgtggattcatttcacatcaagtgaaaagtgaatcccaaaagaattcattggagtccataagtgtaaggttcacaaatgtcccaaactaaacaatacctgcattgcttagataaacaaatatggtaaaactgtaaaaaaacaaaacaaaacaagacaaaaagggctaggaaatgataaacccaaaagacaaaatagcagttatttctgagggaggagggaaggggatggggttggggaagggcacccagagaattttaggagtgatggacttttccttaaattgaatggtgggttcatattgttttgttattctttgtgccttacgtattttacaaataaccaattggatctatgtaatattataatacaaactgagtaaaggattaggttgaggatcacagcattggaagttcttggtgttgaagagagtaagtgccgagcaagttgtgtccctggcagtttgtttgtgaccacctggtggcttacccttcttggtgtggtgaggcttggcatgtcactttccttggctgtggctgttagtactgaatgccattctctctgaggaaaagtgtccttctcttttttattgattgactgattgattgagacagagtctcactctgtcacccaggctggagtgcagtggcgtgatctcggctcactgcatcctctgcctcctgggttcaagcgattctcctgcctcagcctcctgagtagctgggactacaggcgcccactaccacacccagctaatttttgtattcttagtagaaacggggtttcaccaaattattggccaggctggtctcgaactcctgaccatgtgatccacctgcctcggcctcccaaaatgctgggattgtaggtgtgagccatcacgctcagcctttttttttatttaatttaatttttttttaagacagggtctcactctgtcaccccagctagagtgcagtggcacaatcatagctcgctgcagcctccatctcctaggctcaagccatcctcccacctcagcctctcgagtagctggggctataggtgtgcaccaccacacccagctaatttttgtattttttgcagagatggagttttgctgtgctgcttagactggtctcgaactcctgggctcaggcaatcctcctgccttggcctcccaaagtgctgggattacaggcatgagccaccacacctggcctaagagtgtccttctcgttactgtaggcttccctgattgtgactgaggagctgcacctgatcacctttgagaccgaggtgtatcaccaaggcctcaagattgacctagaggtaagttctgcagcagaatcggtgagaggctacgtacaggggtgactcaggacaaaaacttccactgggatttttacaagagaaggtggaatgattactgtttgcttaacactgtgtttatttttgcttacttttctccaaaaaaatccttggcatcccatctggcaataaagtcttgcttgaatgcttagaagatgtgtgtatattcagctttcagcaaacttgatatgaaaatctctatttagaaattgattggccgggcgcggtggctcacgcctgtaatcccagcactttgggaggctgaggcgggtggatcacgaggtcaggagttcgagaccagcctggccaacatgacgaaaccccgtctctactaaaatacaaaaattagctgggtatggtggcggacgcctataatcccagctactcgggaggctgaggcaggagaatcacttgaacctgggaggcagaggttgcagtgagctgagattgtgccattgcactccagcctgggtgacagagtgagactccgtctcaaaaaaaaaaaaaagaaattagaactgactttataaagtttgggcataagagtcttagcagccagtgtgtttagtatacagaaaattgtggcaatgacattctcctttcccaactttcttgatttttaaattaagatatacctagaaaagcaggaatcctggtctttgattcctgagacctccctgtttcatgtgaagatacagcttcaagtcttggagaatgcctccaaggtcttaaaaatggggaatctgtggattgtgagtcaagctttgagcaagtcaggttttacaagggaccggtatattccgactgcagcctgagttgtgtggccacgctgggcattctttccactatgagtgctcactgagctgactcactcacactcctcgcctagagttggcagcaggtgtggtttatggcatgtcctttcattctgagccccgtgagatgcgggtgaagagatttccaaggctgtgagagcccctctgcctccccagctcagtccccactccctccgcagacccactccttgccagttgtggtgatctccaacatctgtcagatgccaaatgcctgggcgtccatcctgtggtacaacatgctgaccaacaatcccaaggttagtgccccctccttttagttggtgccccgggatctcttgcgacttaggggtacctagtatagacaatgagcaccatccctcatctaaacaagcaaatgtgttctttccaatagaatgtaaacttttttaccaagcccccaattggaacctgggatcaagtggccgaggtcctgagctggcagttctcctccaccaccaagcgaggactgagcatcgagcagctgactacactggcagagaaactcttgggtccgcatttcaccccttctccctcccgcccacccgcccagaaaagggatccggcccatagggctgttcatttgggccatgtctactgagcattaggccatgtttctttcctgagcaaggcgctgtgctggtgccaggaaacaggggagttggggagttggggtgcagagacagtttgcagttttcagtcgaggtgatcatttttgaggtgggaggtagatttcttttctcctggttgctgtctcattcacccactctatctaactttagaagatcttttaagtgtgtgttggaaggtggcactaaaggcttgacattccctgtccatttttttaataaactataggctagttggttttttttgtcttattttatttatttatttatttttttgagacgagtcttgctctgttgcccaggctggagtgcagtagtgtgatctcggctcactgcaacctccgccttctgggttcaagcgattcttctgcctcggcctcccgagtagctgagactacaggtgctcaccaccacgcccagctaatttttgtatttttagtagagacggggttttaccatgttggccaggatagtctccgtctcttcacctcgtgatccgcccacctcggcctcctaaagtgctgggattacaggcttgagccactgtgcccagcgtaggctagtttttaaaaaagaattagtggaatattttatgtgccacctgggctagaagtagctttgttctaataaagctgttgccaccaaatacacctgtctgacacccgatgtcagcttgttagtgagtgctgctgttggttcccagcctaccacccgaggttgggaagagcagggggacttgttatatcaccctccatccctgctgggctacccagcaacacaagtgagtcaaatgatgggatagtgtttgtcctcatgtgcacacacacaacagtgcctaccttcaaagatgtgaaagctgattattttgtggcccattgtgggatgaatgtgtgtgtgttctgttttaagaaataacctcttgaccccaagctgaaaatgtactacttgactctttttctttccttcaggacctggtgtgaattattcagggtgtcagatcacatgggctaaattttgcaaagtaagcaatcttgttaaattctcgtgggaatgggaatgctcacctgcacggctgtcgttgagggctctggcttgaaggccctgaactcttggtccagcggccagtaggacctgcctgaaggtagacgggcctgaggatttgggtgatgcactgcacccctaggaagggaagggctgggatggcagtagacttggctttcccattactcttttctccaggaaaacatggctggcaagggcttctccttctgggtctggctggacaatatcattgaccttgtgaaaaagtacatcctggccctttggaacgaagggtaggttggacagagtgtgcacagatgtaaccaagtcccctgctctcagcaagccagtggcaggggatggatgccctgttagcaataacaacattgttcctcctccttggctccaggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagggaggctcccacccaccccacctgctggtggctgctgaggcctcatcactgcttctagttgcaagcacctactgccccctggtgggtggagatggccttgactccctgtttcactcagactcgcaaaacacatttgcgtgacttctaaatccttccagctgaaggattggtttgctttgttttgcttgctccagtgactatttgttgagaattttgcaatttaaattgtattcttcatctctttttctacttaaccctgttaatatatcttacgcaagtagttatattcaagtttattttctatgacccaactagtagcctcttcttaattagaagccagcctgaatatttccacagtgccaggccactgaacagggtgttcagggtctcaacactagggtggcttaagtcttttccccttcgaggaaagaaaaaatgggcagttttctctgagatgacctagctgtaggttccatgatctttccttcccatgtcctgtgacaggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagttgttgattttccatgttcctggcatttaatttttgggaaaagttggaaattttgggatccttggaggatagataggcaaatgcctgaataacctgggggataattatttctccttatgggaaagaattgtagtgagtgcttttgttggggtgaccgatgggatttgagaggagaatcagaatcacttagagtagtgtagttcctgctccacagagagtgcatgagtctaaagaggggatacagcctgggcaatatggtgaaacctcgtctctacaaaaaatccaaaaaaattacccggtgtggtggcacgcatttgtagtcgtagctacttgggaggctgaggtgggaggatcacctgagccaaggagttcaaggctgtagtgagcggtgatcatgccaccgcactccagcctggctgatagagtgagatactgtgtcaaaaaataaaaataaagaggggatcaatacacatacgtcccccaaaacatgcctgaaacacgagaagggaaagtgagggcagttaacaggatgccctgctggcacagtgcttcttagtagatgctagaaggtttgaggcccagatttcagcccagcatatggctttttgcctgtaactgaaccatgtcagtgtgccagatggtctgaagaaagggtttctggaggaaattattattagctgcatgggagtatggtttacactagagtagaagagctgggagcatcacgtttgaaggggaagacagtgactgggtggaggggcaagggattagtatttagagtgtgcaactattgaaaataaggtatattttaatgtgtaagaggacatgtacttatatgttatatataaattattttagctgggtgaagtggctcatgcctatagtcctagcactttgggaggcccaggcgggaggatcacttgagcctgggagtttgagaacagcctagacaacatagtgagaccctatctatacaaaaataattttttttaaattagccacgtgtggtggtttgtgcctgtagtcctagctactcgggaggctgaggtgggaggattgcttaagcccaggaggttgaggctgcagtgagccatgatcgcaccactgcactccagcctgggtgacagagcaagaccttgactcaccaaaaaaaaaaaaaaaaaaaagagagagaaattaaaaatactgtaatctcagctgggcatgggggttcacacctgcagtcctagcactttgggaggctgaagcaggaggatcacttgaggccaggaactcaagaccagcctggcaacatagcaagaccccactacacacacacacacacacacacacaaagaagagaaagaaaaaaacgaaacaaaactgtaatctctgcagctgtcctcagtgtggagggggtagccctgtctgttccccttcagcacttgctgttttgactctctgggttctttgtgcaggtcttgatggggagtctctggtttgccattctttgtttgatttaactttctgtaatcataaagccaatgatgggctttttttttttttttttttttagactaagtcttgctctatcacccaagctggagtgcagtggcaccatctcggctcactgcaacctccacctcccggttcaagcaattctcctgcctcagcctcccgagtagctgggattatgggcttgtgccaccatgcccagctgatttttgtattttttgtagagaaagggtttcgccatgttggccaggctggcctcgaactcctgacctcaggtgatctgcccacttcagcctcccaaagtgctgggattacaggcgtgagccactgtgcctggcctaatgatgggctctttaatgtgatcctttagggttggcgccttgccctagttgctgttgaaaaaactatttttgtccaaatagcacacacacagaaacctaccaacttccctcccactttttcctaggaattccttctgagggatttcttgagatggggcagaatggggcttggaagagggagttggagctaattgaccgttgcctttctcctttgttggggtcctgagtcttgttcctgctgtaagagttactcacttcctgtctgccacctatctccctttgcatgtgtgcttcagttgggagatctgtttatcagcccctgccacacggctctttgttccttctgcagaggacgttggggtcccacggctggtccttttgactcattttgctttcaaggtcccacctcccagtctgaggctgcatcctccattaccatcgcccttcctgtgggctgggaggccaggtcctttcctgcccagcgatgtcagcgtttcctcaggggccaggcactcatcaggagaaaggaactaattacttgagtaatttgccttgccttgctgagaggagtgtgccctgagggactccatgtgagtgtggtgacgggtgtgggggtgtccctgtgttattttaaaatgggtgccttcaggacgatgagcatgtgaccatttcctctctatttccatcacaagagtattatggtatgagggtctcaggttagattatcctcccaagactcttctctcttccttctctactggaagcccacatagcatttccttatggcttgagggagaggttcggagccacttacaaattagataaagtacatttacaatcttgtacaaagccacacaatgaagtcatttttctcagctttttttttttttttttttttttttttgagcctgagtctcgctctatcgtccagactggagtgcagtggcgcgatcttgcttcactgaaacctctgcctcccaggttcaagagattctcatacctcagcctcctgagtagctgggattacagacatgcaccactatgcctggctaatttttggatttttagtagagaccgggtttcaccctgttggccaggctggtctcgaacccctgacctcaagtgatcttcccgcctgggcctcccaaagtgctgggattataggtgtgagccacagtgcccagccttgtttttgtttttgttttgttttgacagtctgtcactctgtcacccaggctggagtgcagtggtgcgatctcacctcacttcagcctctgcctcccaggttcaagtgattctcctgtctcagcctcctgagtagctgggattacaggcgtgccaccacgcccagctatttttgtaatttcattaaagacagggtttccccatgttggtgaggctggtcttgaactcctggcctcaagtgatccacctgcttcagcctcccaaagtgcagggattacaggcatgagccactgtgcctggcctcagctatcttgaatgctggagaattaaatccttttctgtctagggtgtcagctccctaagggctgggccaaaacagttggatttataagacactagagtcttgcctcagtagctcctttgaattctgcactgaattgatcagtttcttggcccaaagtaaactcagatggcagcccaagagccactctgcagtgccttctttcacatggtcatcatgctctctgatccctcaggttctgtctaagcctcatgttttatgaccgtgctgttctcagcccacctcaccctgccccatgccttctcaatggtttgttcacctgaattccccagatttcatgccagtatccccaaggttccttgacctcttggtgtaagcattcagcatctaaaattcattttattcccgtcaacgcatttctaactgtagaacaagaattataaatgacaaagctcatagaaaattggcaccttgtcttccccctccctcttattttatacataaaagagaatatgggctgggcattgtggccaaggctgggcatgatagctcatacttgtaatccagcactttgggagggtgaggcagatggatcacctgaggtcaggagttcaagaccagcctggccaacatggtgaaacctcatctctactaaaattacaaaaaaaaaattagctaggcatggtggcagatgcctgtaatccagctactcaggaggctgatgaaggagaatcacttgaaccctggaggcagaggttgtagagagccaagatggcgctactgcactccaacctgggcgaaagagagcaagactccgtctcaaaaaaaaaaaagacaaaaattagccaggcatggtggtgccacctgtagtcccagctgcttgggagcctaaggcaggagaatcgttttgacctgggagtaggaggttgcggtaaccgagattgtgccactgcacttgagcctgggcaacagagtgagactctgtctcaaaacaataagaacaacagcaacaaaagagagagaccatgccttgctccaggtctcttagctattgaagatgtacctggacccaggtctccggtcttctagttgaagcaattgtactgccttacaaagtcacattctctttggtgctttttgattgacgtatttatccaactagaaagttactcatgccctcatccaaaaatgtggtagaggccagattagtgctggtaggaataagagatataacctttggctttggaaccacaagcattagcagtctccatgttctttaaagacttggtgatattggtatttaggctggacaccatgcaaagactacacaggctcggttcctgcatgcagagaagttatctaagagatatgaccaggccggaatagaatgctcagaccacgtggaggctgttaaacttttacataatctagggaaagaagggacacaaggtggcattagtctagggtcaggtgggaaaaggttatgctgaaaagtctctgcagctcaggacagctttgtgcaaagaactgaagttcacagctgctagtgcctgggagatcaaatagtataaatgagggcagacaaccctgaggggcagatggagctttccagacaatcttggcatgaggatgagtgagtttcaaatcagtcctgccgaggcagatggcttcctccagctctgcttactgaatgcgaagtcacagtcagtaagaaaactggttttcttcttcccaggcgctgccccatacctgaagaccaagtttatctgtgtgacaccgtaagtggcttcctttccccgttttgccttcatttctaatatcctcagttatccctgggaatgggacactgggtgagagttaatctgccaaaggttggaagcccctgggctatgtttagtactcaaagtgaccttgtgtgtttaaaaagcttgagcttttatttttctgttggagaccagagtttgatggcttgtgtgtgtgtgttttgttcttttttttttttccattgtgtcttgtcaaccccccgtttcccctcctgctgccccccatttcctacagaacgacctgcagcaataccattgacctgccgatgtccccccgcactttagattcattgatgcagtttggaaataatggtgaaggtgctgaaccctcagcaggagggcagtttggtgagtatttggttgacagactttgtccctataagggaagttggtcccctttgtgtgatgctctcacatgtacacaccgagagctggtcactcggaatggtaggagattctagagctttgctttccaaaagagatggtatgaatgccacatgtgtgagtataaatcttctagcagccacactggaaatagacgaacttaatttttacaatatattttatttaacccactaaatccaacatactctcaatttaacatttcagaaaaagttgaggctgggtgagtggctcatgcctgtaatcccagcactttgggaggccgaggtgggtggatcacttgaggtcaggagttcgagaccagtctgaccaaaatctctaaaatataaaaattagctgggcatggtggcgcatacctgtaatcccagctactcaagaagctgaggtgggaggatcgcttgagcctgggaggtggaggttgcagtgagcagagatcgtgccactgcactccagcctgggcgacagagtgagactccatctcaaataaacaaaactaaactaaaaagaaaaagttgagacctttttttattcttttttttcatactaagcctttaaaatccagtgggcttttgacagccacagcacagctcagtttggacaaaccaaatctcaaatgcttggtggccacgtgtgtctcggggctcctgaattaaacagtagatcaagggcagaagatctcaggacagccttagagcttctgtaaacatggagctctgggaatcagttaaggtgggaatgagaaaggacccttcccgaggcagggtcctccagggaggagggtaaatctggcttttctgaccatccctgggccttaaggggcaggagattggatagcagtggtagcctgggccctgtcctctgaagggctgggggcgtggcctgccagttgcagagggtggacaactgaactagttttccctgtctgtccctccagagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtctgatagcatggcagctctgtttggctggtggaggcttccttttcccctgcataagttctgagggggcctcacacacaggtggggcctgggataagggccggaaagggtcttgagaggaggtggttgccttaatcccccccgccaacccccttatgttagccaccagcccggaggtaaggggtgcctggaggagcaggaggtcaatagtccaacggcagaaaggtgtcagagtggaggcctccctccccggccccctcctaccccccagagcggcctcgtcctgtctggggtcagataagccacctaagcggggtggggggtagatactcccaccgcaccaaggcctccccttccacagttggctcctttatcactttcccttcagttcacccagcggggacaacacgcagacacccggtggtggctgcagggcccccggcagccagcggtgataatgcagggaaaggcgccccaacctcagctacgcgggcgcccacagggcttctccccacccctacacgtgccccagcgccctggagaccgcgcctgggagctacgagcgagcaccttccctcgcagagatggatcagattagccccctggggcggtggcacctgcccgtcccctcccctcctctcttctcccacccccgccttccccctgctctgggccccctgcacctccctcttggggcccacgcgccgcccctctccctcgcttgagctctgagctcagaaggaacctgcccgcaaacctggctcccagccccgcccagggagcgcgcgtccctgagcccaagggccccagcgacagcagggactggctgcagccggcagtgcgggggtccagccggggcgagccggtcccgcttgctgcacctccgcctcgcacagtcgccggcagccagctgaaaacagcgcagccgcgtggtgccacctgctggtctctgggaaggaggaggatgggacggttgttgcggctctgggactgcccctggccccgagggttgagaagcatcttggcgccgggccctcagccgccagcttcgaggctgctgggagcagcagctgctaaggagaagcctgggtcagagttctgcccacccgcgcccatctccatcatttccccaaacctcgagtcccctgctttttaaggaatctgtgccccctaaactggctccttacccttctgagaagcattgacagtattccaggggtggccagcaccctgaaaaccacagcaaagcgggcagagttaaaatttaagactaaaaatgacagcatcaggcatgcacgcgggaaggaacagaacaaccagctccaggggttcccatcacccagggaggccaccaacgccccaaccaggagccatagcagcaaatttatgaaaaaaatattttattccaaaacactgtttacacaaatgtgtggtctttgtacaaagtacaaaaaaacccctcttctcatccccacctcccttcagagaagtttaaaccttgggctctcaatcttccatggtcagctgcccctgactgcgagtcctacagcctcagagggaggagcgtgtggggttgggagcaaggcctcaccagaacacagccagttacgcaacagcgcaaggcctgctccaggccccacctccagcggagtcaaaccagatcagcttttacccctcactccagattccacaggcacgcagcacatggctgatttgcagcttgtctttcactgcagttttttgtttttgttttttccaggaggcaagaggaccaaccctccaagtcccggggcccctgtccacccaccatatcctagacccaatcttttctacctctttgtcgacaaggttacaaacagagaggcaagcaaagaaggctggggcccaacggaggggagagaatatatatcccgggaaacgtgggcaacagcatcatagacttgaatgaagcccaaggccaagcagccaagcaaggactaattcagagcagctcagaaaccctcactcaaaccggcggcccccctgtgctaaggacatggccgggcccagacgcgctctcatagggttcacagagagtctggagtccacgttcactaaagtataaaatactactcgaaaatgaaccccagcctcccttctgagagatgaatcggttacatcaacacatgaggacagatgcatttacatagacccacacactctctctttctctctctctgtctctctgtctctctctcttaggagggcaaagcttctcactccggagtgaaacttcagcttacagacgttacctgtctcccctccccttctgaatcatctcattcaaatagctgctgagcagatgaggggcccaggaggaataggtctggctgcattgagtgcctgcagtgacagaggctcggtctctaccatgacagagacagactcggcgcactcttggatgccatgatctgaaaagaggccaccgctgctgcagccacatcccaggactgcacaggggaggcaggcgtagctcatgcacaaggacacacacacacacacacacacaagcacatgcatgcctgcaaaggtgtcagtgtacacagccttactaaactcacaacacgaccgcttcacattgcatattgtttccaaagagaagcgtgggattcaaacattcatgagagggagcctctggcagaggtgaaaagaccggcagggggcgagaggcgggagtcaagactgtccattggtcggcgtaagagttcctccacgtgcctggccacatccatggtctcatccaggtcgaattctccatcctgatcgagtacatggtcagggctggtaaagacagggggatgtca

SEQ ID NO: 149 - DNA, 20 bp, Artificial Sequence
  Synthetic oligonucleotide
gactcttgcaggaatcggct

SEQ ID NO: 150 - DNA, 20 bp, Artificial Sequence
  Synthetic oligonucleotide
agcgaggcttcacttggcgc

SEQ ID NO: 151 - DNA, 20 bp, Artificial Sequence
  Synthetic oligonucleotide
gggaagcgaggcttcacttg

SEQ ID NO: 152 - DNA, 20 bp, Artificial Sequence
  Synthetic oligonucleotide
gcggtcagcgatcccagggt

SEQ ID NO: 153 - DNA, 20 bp, Artificial Sequence
  Synthetic oligonucleotide
gggtgccagcgcggtgatct

SEQ ID NO: 154 - DNA, 20 bp, Artificial Sequence
  Synthetic oligonucleotide
tgttacaaagaaagtgactg

SEQ ID NO: 155 - DNA, 20 bp, Artificial Sequence
  Synthetic oligonucleotide
cgatggcagcaacggaagtt

SEQ ID NO: 156 - DNA, 20 bp, Artificial Sequence
  Synthetic oligonucleotide
gtcagtttacgatggcagca

SEQ ID NO: 157 - DNA, 20 bp, Artificial Sequence
  Synthetic oligonucleotide
cagggctttgtttcgaaaaa

SEQ ID NO: 158 - DNA, 20 bp, Artificial Sequence
  Synthetic oligonucleotide
ccattttcttccacagggct

SEQ ID NO: 159 - DNA, 20 bp, Artificial Sequence
  Synthetic oligonucleotide
atgcttcttcaagttttcca

SEQ ID NO: 160 - DNA, 20 bp, Artificial Sequence
  Synthetic oligonucleotide
cagaatgactttaatgcttc

SEQ ID NO: 161 - DNA, 21 bp, Artificial Sequence
  Primer
ccaccgcaaatgcttctagac

SEQ ID NO: 162 - DNA, 20 bp, Artificial Sequence
  Primer
cccccccattgagaagattc

SEQ ID NO: 163 - DNA, 24 bp, Artificial Sequence
  Probe
ctccacctccagcacgcgacttct

SEQ ID NO: 164 - DNA, 18 bp, Artificial Sequence
  Primer
agcctgagccgggagatg

SEQ ID NO: 165 - DNA, 21 bp, Artificial Sequence
  Primer
gcgtagttgactggcgaagtt

SEQ ID NO: 166 - DNA, 21 bp, Artificial Sequence
  Probe
aggccatccgcacggacaacc

SEQ ID NO: 167 - DNA, 15 bp, Artificial Sequence
  Primer
cgggccgtccgtgtt

SEQ ID NO: 168 - DNA, 20 bp, Artificial Sequence
  Primer
ctttgcactttgcgaaccaa

SEQ ID NO: 169 - DNA, 21 bp, Artificial Sequence
  Probe
catcctccacgcacccccacc

SEQ ID NO: 170 - DNA, 14411 bp, Homo sapiens
ctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtggggtgagtgcctaccctcggggctcctgcagatggggtgggggtggggcaggagacaggtctgggcacagaggcctggctgttgggggggcaggatggcaggatgggcatggggagatcctcccatcctggggctcagagtgtggacctgggccctggggcaacatttctctgtcctatgccaccactctggaggggcagagtaaggtcagcagaggctagggtggctgtgactcagagccatggcttaggagtcacagcaggctaggctgccaacagcctcccatggcctctctgcaccccgcctcagggtcagggtcagggtcatgctgggagctccctctcctaggaccctccccccaaaagtgggctctatggccctctcccctggtttcctgtggcctggggcaagccaggagggccagcatggggcagctgccaggggcgcagccgacaggcaggtgttcggcgccagcctctccagctgccccaacaggtgcccaggcactgggagggcggtgactcacgcgggccctgtgggagaaccagctttgcagacaggcgccaccagtgccccctcctctgcgatccaggagggacaactttgggttcttctgggtgtgtctccttcttttgtaggttctgcacccacccccacccccagccccaaagtctcggttcctatgagccgtgtgggtcagccaccattcccgccaccccgggtccctgcgtcctttagttctcctggcccagggcctccaaccttccagctgtcccacaaaaccccttcttgcaagggctttccagggcctggggccagggctggaaggaggatgcttccgcttctgccagctgccttgtctgcccacctcctccccaagcccaggactcgggctcactggtcactggtttctttcattcccagcaccctgcccctctggccctcatatgtctggccctcagtgactggtgtttggtttttggcctgtgtgtaacaaactgtgtgtgacacttgtttcctgtttctccgccttcccctgcttcctcttgtgtccatctctttctgacccaggcctggttcctttccctcctcctcccatttcacagatgggaaggtggaggccaagaagggccaggccattcagcctctggaaaaaccttctcccaacctcccacagcccctaatgactctcctggcctccctttagtagaggatgaagttgggttggcagggtaaactgagaccgggtggggtaggggtctggcgctcccgggaggagcactccttttgtggcccgagctgcatctcgcggcccctcccctgccaggcctggggcgggggagggggccagggttcctgctgccttaaaagggctcaatgtcttggctctctcctccctcccccgtcctcagccctggctggttcgtccctgctggcccactctcccggaaccccccggaacccctctctttcctccagaacccactgtctcctctccttccctcccctcccatacccatccctctctccatcctgcctccacttcttccacccccgggagtccaggcctccctgtccccacagtccctgagccacaagcctccaccccagctggtcccccacccaggctgcccagtttaacattcctagtcataggaccttgacttctgagaggcctgattgtcatctgtaaataaggggtaggactaaagcactcctcctggaggactgagagatgggctggaccggagcacttgagtctgggatatgtgaccatgctacctttgtctccctgtcctgttccttcccccagccccaaatccagggttttccaaagtgtggttcaagaaccacctgcatctgaatctagaggtactggatacaaccccacgtctgggccgttacccaggacattctacatgagaacgtgggggtggggccctggctgcacctgaactgtcacctggagtcagggtggaaggtggaagaactgggtcttatttccttctccccttgttctttagggtctgtccttctgcagactccgttaccccaccctaaccatcctgcacacccttggagccctctgggccaatgccctgtcccgcaaagggcttctcaggcatctcacctctatgggagggcatttttggcccccagaaccttacacggtgtttatgtggggaagcccctgggaagcagacagtcctagggtgaagctgagaggcagagagaaggggagacagacagagggtggggctttcccccttgtctccagtgccctttctggtgaccctcggttcttttcccccaccacccccccagcggagcccatcgtggtgaggcttaaggaggtccgactgcagagggacgacttcgagattctgaaggtgatcggacgcggggcgttcagcgaggtaagccgaaccgggcgggagcctgacttgactcgtggtgggcggggcataggggttggggcggggccttagaaattgatgaatgaccgagccttagaacctagggctgggctggaggcggggcttgggaccaatgggcgtggtgtggcaggtggggcggggccacggctgggtgcagaagcgggtggagttgggtctgggcgagcccttttgttttcccgccgtctccactctgtctcactatctcgacctcaggtagcggtagtgaagatgaagcagacgggccaggtgtatgccatgaagatcatgaacaagtgggacatgctgaagaggggcgaggtgaggggctgggcggacgtggggggctttgaggatccgcgccccgtctccggctgcagctcctccgggtgccctgcaggtgtcgtgcttccgtgaggagagggacgtgttggtgaatggggaccggcggtggatcacgcagctgcacttcgccttccaggatgagaactacctggtgagctccgggccggggtgactaggaagagggacaagagcccgtgctgtcactggacgaggaggtggggagaggaagctctaggattgggggtgctgcccggaaacgtctgtgggaaagtctgtgtgcggtaagagggtgtgtcaggtggatgaggggccttccctatctgagacggggatggtgtccttcactgcccgtttctggggtgatctgggggactcttataaagatgtctctgttgcggggggtctcttacctggaatgggataggtcttcaggaattctaacggggccactgcctagggaaggagtgtctgggacctattctctgggtgttgggtggcctctgggttctctttcccagaacatctcagggggagtgaatctgcccagtgacatcccaggaaagtttttttgtttgtgtttttttttgaggggcgggggcgggggccgcaggtggtctctgatttggcccggcagatctctatggttatctctgggctggggctgcaggtctctgcccaaggatggggtgtctctgggaggggttgtcccagccatccgtgatggatcagggcctcaggggactaccaaccacccatgacgaaccccttctcagtacctggtcatggagtattacgtgggcggggacctgctgacactgctgagcaagtttggggagcggattccggccgagatggcgcgcttctacctggcggagattgtcatggccatagactcggtgcaccggcttggctacgtgcacaggtgggtgcagcatggccgaggggatagcaagcttgttccctggccgggttcttggaaggtcagagcccagagaggccagggcctggagagggaccttcttggttggggcccaccggggggtgcctgggagtaggggtcagaactgtagaagccctacaggggcggaacccgaggaagtggggtcccaggtggcactgcccggaggggcggagcctggtgggaccacagaagggaggttcatttatcccacccttctcttttcctccgtgcagggacatcaaacccgacaacatcctgctggaccgctgtggccacatccgcctggccgacttcggctcttgcctcaagctgcgggcagatggaacggtgagccagtgccctggccacagagcaactggggctgctgatgagggatggaaggcacagagtgtgggagcgggactggatttggaggggaaaagaggtggtgtgacccaggcttaagtgtgcatctgtgtggcggagtattagaccaggcagagggaggggctaagcatttggggagtggttggaaggagggcccagagctggtgggcccagaggggtgggcccaagcctcgctctgctccttttggtccaggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggtgagcacggccgcagggagacctggcctctcccggtaggcgctcccaggctatcgcctcctctccctctgagcaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggtaggtacctgtggcccctgctcggctgcgggaacctccccatgctccctccataaagttggagtaaggacagtgcctaccttctggggtcctgaatcactcattccccagagcacctgctctgtgcccatctactactgaggacccagcagtgacctagacttacagtccagtgggggaacacagagcagtcttcagacagtaaggccccagagtgatcagggctgagacaatggagtgcagggggtgggggactcctgactcagcaaggaaggtcctggagggctttctggagtggggagctatctgagctgagacttggagggatgagaagcaggagaggactcctcctcccttaggccgtctctcttcaccgtgtaacaagctgtcatggcatgcttgctcggctctgggtgcccttttgctgaacaatactggggatccagcacggaccagatgagctctggtccctgccctcatccagttgcagtctagagaattagagaattatggagagtgtggcaggtgccctgaagggaagcaacaggatacaagaaaaaatgatggggccaggcacggtggctcacgcctgtaaccccagcaatttggcaggccgaagtgggtggattgcttgagcccaggagttcgagaccagcctgggcaatgtggtgagacccccgtctctacaaaaatgttttaaaaattggttgggcgtggtggcgcatgcctgtatactcagctactagggtggccgacgtgggcttgagcccaggaggtcaaggctgcagtgagctgtgattgtgccactgcactccagcctgggcaacggagagagactctgtctcaaaaataagataaactgaaattaaaaaataggctgggctggccgggcgtggtggctcacgcctgtaatctcagcactttgggaggccgaggcgggtggatcacgaggtcaggagatcgagaccatcttggctaacacggtgaaaccccatctctcctaaaaatacaaaaaattagccaggcgtggtggcgggcgcctgtagtcccagctactcaggaggctgaggcaggagaatggcgtgaacccgggaggcagagtttgcagtgagccgagatcgtgccactgcactccagcctgggcgacagagcgagactctgtctcagaaaaaaaaaaaaaaaaaaaaaaaaataggctggaccgcggccgggcgctgtggctcatgcctgtaatcccagcactttgggagtccaaggccggtgggtcatgagatcaggagttttgagactaggctggccaacacggtgaaaccccgtctctactaaaaatacaagaaaattagctgggtgtggtctcgggtgcctgtaattccagttactggggaagctgaggcaggagaattgcttgaacctgggaggcagagtttgcagtgagccaagatcatgccactacactccagtctgggtgacagagtgagactctgtctcaaaaaaaaaaaaaaaaaaaagggttgggcaaggtggttcacgcctgtaatcccagaactttgggaggctgaggcaggcagatcactggaagtcaggagttcaagaccagcctggccaacatggtgaaaccctgtgtctactaaaaatacaaaatttagccaggcttggtggcgtatgcctgtaatgccagctactcaggaggctgaggcaggagaatcgcttgattgaacctgggaggcagagtttgcagtgggctggggttgtgccactgcactctaggctgggagacagcaagactccatctaaaaaaaaaaaacagaactgggctgggcacagtggcttatatttgtaatcccagcactttgggaggctgaggttggaggactgcttgagcccagagtttgggactacaacagctgaggtaggcggatcacttgaggtcagaagatggagaccagcctggccagcgtggcgaaaccccgtctctaccaaaaatataaaaaattagccaggcgtggtagagggcgcctgtaatctcagctactcaggacgctgaggcaggagaatcgcctgaacctgggaggcggaggttgcagtgagctgagattgcaccactgcactccagcctgggtaacagagcgagactccgtatcaaagaaaaagaaaaaagaaaaaatgctggaggggccactttagataagccctgagttggggctggtttggggggaacatgtaagccaagatcaaaaagcagtgaggggcccgccctgacgactgctgctcacatctgtgtgtcttgcgcaggagacactgtcggacattcgggaaggtgcgccgctaggggtccacctgccttttgtgggctactcctactcctgcatggccctcaggtaagcactgccctggacggcctccaggggccacgaggctgcttgagcttcctgggtcctgctccttggcagccaatggagttgcaggatcagtcttggaaccttactgttttgggcccaaagactcctaagaggccagagttggaggaccttaaattttcagatctatgtacttcaaaatgttagattgaattttaaaacctcagagtcacagactgggcttcccagaatcttgtaaccattaacttttacgtctgtagtacacagagccacaggacttcagaacttggaaaatatgaagtttagacttttacaatcagttgtaaaagaatgcaaattctttgaatcagccatataacaataaggccatttaaaagtattaatttaggcgggccgcggtggctcacgcctgtaatcctagcactttgggaggccaaggcaggtggatcatgaggtcaggagatcgagaccatcctggctaacacggtgaaaccccgtctctactaaaaatacaaaaaaattagccgggcatggtggcgggcgcttgcggtcccagctacttgggaggcgaggcaggagaatggcatgaacccgggaggcggagcttgcagtgagccgagatcatgccactgcactccagcctgggcgacagagcaagactccgtctcaaaaaaaaaaaaaaaaaagtatttatttaggccgggtgtggtggctcacgcctgtaattccagtgctttgggaggatgaggtgggtggatcacctgaggtcaggagttcgagaccagcctgaccaacgtggagaaacctcatctctactaaaaaacaaaattagccaggcgtggtggcatatacctgtaatcccagctactcaggaggctgaggcaggagaatcagaacccaggagggggaggttgtggtgagctgagatcgtgccattgcattccagcctgggcaacaagagtgaaacttcatctcaaaaaaaaaaaaaaaaaagtactaatttacaggctgggcatggtggctcacgcttggaatcccagcactttgggaggctgaagtggacggattgcttcagcccaggagttcaagaccagcctgagcaacataatgagaccctgtctctacaaaaaattgaaaaaatcgtgccaggcatggtggtctgtgcctgcagtcctagctactcaggagtctgaagtaggagaatcacttgagcctggagtttgaggcttcagtgagccatgatagattccagcctaggcaacaaagtgagacctggtctcaacaaaagtattaattacacaaataatgcattgcttatcacaagtaaattagaaaatacagataaggaaaaggaagttgatatctcgtgagctcaccagatggcagtggtccctggctcacacgtgtactgacacatgtttaaatagtggagaacaggtgtttttttggtttgtttttttccccttcctcatgctactttgtctaagagaacagttggttttctagtcagcttttattactggacaacattacacatactataccttatcattaatgaactccagcttgattctgaaccgctgcggggcctgaacggtgggtcaggattgaacccatcctctattagaacccaggcgcatgtccaggatagctaggtcctgagccgtgttcccacaggagggactgctgggttggaggggacagccacttcataccccagggaggagctgtccccttcccacagctgagtggggtgtgctgacctcaagttgccatcttggggtcccatgcccagtcttaggaccacatctgtggaggtggccagagccaagcagtctccccatcaggtcggcctccctgtcctgaggccctgagaagaggggtctgcagcggtcacatgtcaagggaggagatgagctgaccctagaacatgggggtctggaccccaagtccctgcagaaggtttagaaagagcagctcccaggggcccaaggccaggagaggggcagggcttttcctaagcagaggaggggctattggcctacctgggactctgttctcttcgctctgctgctccccttcctcaaatcaggaggtcttggaagcagctgcccctacccacaggccagaagttctggttctccaccagagaatcagcattctgtctccctccccactccctcctcctctccccagggacagtgaggtcccaggccccacacccatggaactggaggccgagcagctgcttgagccacacgtgcaagcgcccagcctggagccctcggtgtccccacaggatgaaacagtaagttggtggaggggagggggtccgtcagggacaattgggagagaaaaggtgagggcttcccgggtggcgtgcactgtagagccctctagggacttcctgaacagaagcagacagaaaccacggagagacgaggttacttcagacatgggacggtctctgtagttacagtggggcattaagtaagggtgtgtgtgttgctggggatctgagaagtcgatctttgagctgagcgctggtgaaggagaaacaagccatggaaggaaaggtgccaagtggtcaggcgagagcctccagggcaaaggccttgggcaggtgggaatcctgatttgttcctgaaaggtagtttggctgaatcattcctgagaaggctggagaggccagcaggaaacaaaacccagcaaggccttttgtcgtgagggcattagggagctggagggattttgagcagcagagggacataggttgtgttagtgtttgagcaccagccctctggtccctgtgtagatttagaggaccagactcagggatggggctgagggaggtagggaagggagggggcttggatcattgcaggagctatggggattccagaaatgttgaggggacggaggagtaggggataaacaaggattcctagcctggaaccagtgcccaagtcctgagtcttccaggagccacaggcagccttaagcctggtccccatacacaggctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccaggtcgggatcggggccggggccggggccgggatgcgggccggtggcaacccttggcatcccctctcgtccggcccggacggactcaccgtccttacctccccacagtcaactacgcgaggcagaggctcggaaccgggacctagaggcacacgtccggcagttgcaggagcggatggagttgctgcaggcagagggagccacaggtgagtccctcatgtgtccccttccccggaggaccgggaggaggtgggccgtctgctccgcggggcgtgtatagacacctggaggagggaagggacccacgctggggcacgccgcgccaccgccctccttcgcccctccacgcgccctatgcctctttcttctccttccagctgtcacgggggtccccagtccccgggccacggatccaccttcccatgtaagacccctctctttcccctgcctcagacctgctgcccattctgcagatcccctccctggctcctggtctccccgtccagatatagggctcaccctacgtctttgcgactttagagggcagaagccctttattcagccccagatctccctccgttcaggcctcaccagattccctccgggatctccctagataacctccccaacctcgattcccctcgctgtctctcgccccaccgctgagggctgggctgggctccgatcgggtcacctgtcccttctctctccagctagatggccccccggccgtggctgtgggccagtgcccgctggtggggccaggccccatgcaccgccgccacctgctgctccctgccagggtacgtccggctgcccacgcccccctccgccgtcgcgccccgcgctccacccgccccttgccacccgcttagctgcgcatttgcggggctgggcccacggcaggagggcggatcttcgggcagccaatcaacacaggccgctaggaagcagccaatgacgagttcggacgggattcgaggcgtgcgagtggactaacaacagctgtaggctgttggggcgggggcggggcgcagggaagagtgcgggcccacctatgggcgtaggcggggcgagtcccaggagccaatcagaggcccatgccgggtgttgacctcgccctctccccgcaggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagaggaccctggagacggaggcgtgcagaag

SEQ ID NO: 171 - DNA, 20 bp, Artificial Sequence
  Synthetic oligonucleotide
tgctcccgacaagctccaga

SEQ ID NO: 172 - DNA, 20 bp, Artificial Sequence
  Synthetic oligonucleotide
ttgcactttgcgaaccaacg

SEQ ID NO: 173 - DNA, 20 bp, Artificial Sequence
  Synthetic oligonucleotide
aagaaagctttgcactttgc

SEQ ID NO: 174 - DNA, 20 bp, Artificial Sequence
  Synthetic oligonucleotide
gtcggaggacgaggtcaata

SEQ ID NO: 175 - DNA, 20 bp, Artificial Sequence
  Synthetic oligonucleotide
cggagcggttgtgaactggc

SEQ ID NO: 176 - DNA, 20 bp, Artificial Sequence
  Synthetic oligonucleotide
ccttccctgaaggttcctcc

SEQ ID NO: 177 - DNA, 20 bp, Artificial Sequence
  Synthetic oligonucleotide
ttgctcagtaagaattttcg

SEQ ID NO: 178 - DNA, 22 bp, Artificial Sequence
  Synthetic oligonucleotide
ggttcgggataagatcatcaca

What is claimed is:

1. A method comprising administering to an animal an antisense oligonucleotide consisting of 12 to 30 linked nucleosides and having a nucleobase sequence comprising at least 12 contiguous nucleobases of any of the nucleobase sequences of SEQ ID NOs: 150, 151, 152, 153, 154, 155, 156, 157, 158, 159, and 160, and wherein the nucleobase sequence of the antisense oligonucleotide is at least 80% complementary to an alpha1 actin RNA as measured over the entirety of the antisense oligonucleotide.

2. The method of claim 1, wherein the antisense oligonucleotide is chimeric.

3. The method of claim 1, wherein the antisense oligonucleotide is a gapmer.

4. The method of claim 1, wherein the nucleobase sequence of the antisense oligonucleotide is at least 95% complementary to alpha1 actin RNA as measured over the entirety of said antisense oligonucleotide.

5. The method of claim 1, wherein the nucleobase sequence of the antisense oligonucleotide is 100% complementary to alpha1 actin RNA as measured over the entirety of said antisense oligonucleotide.

6. The method of claim 1, wherein at least one internucleoside linkage of said antisense oligonucleotide is a modified internucleoside linkage.

7. The method of claim 6, wherein each internucleoside linkage is a phosphorothioate internucleoside linkage.

8. The method of claim 1, wherein at least one nucleoside of said antisense oligonucleotide comprises a modified sugar.

9. The method of claim 8, wherein at least one modified sugar is a bicyclic sugar.

10. The method of claim 8, wherein at least one modified sugar comprises a 2'-O-methoxyethyl or a 4'-$(CH_2)_n$—O-2' bridge, wherein n is 1 or 2.

11. The method of claim 1, wherein at least one nucleoside of said antisense oligonucleotide comprises a modified nucleobase.

12. The method of claim 11, wherein the modified nucleobase is a 5-methylcytosine.

13. The method of claim 1, wherein the antisense oligonucleotide comprises:
   a gap segment consisting of linked deoxynucleosides;
   a 5' wing segment consisting of linked nucleosides;
   a 3' wing segment consisting of linked nucleosides;
   wherein the gap segment is positioned between the 5' wing segment and the 3' wing segment and wherein each nucleoside of each wing segment comprises a modified sugar.

14. The method of claim 13, wherein at least one internucleoside linkage of said antisense oligonucleotide is a modified internucleoside linkage.

15. The method of claim 14, wherein each internucleoside linkage is a phosphorothioate internucleoside linkage.

16. The method of claim 13, wherein at least one nucleoside of said antisense oligonucleotide comprises a modified sugar.

17. The method of claim 16, wherein at least one modified sugar is a bicyclic sugar.

18. The method of claim 16, wherein at least one modified sugar comprises a 2'-O-methoxyethyl or a 4'-$(CH_2)_n$—O-2' bridge, wherein n is 1 or 2.

19. The method of claim 13, wherein the antisense oligonucleotide consists of 20 linked nucleosides.

20. The method of claim 19, wherein the antisense oligonucleotide comprises:
   a gap segment consisting of ten linked deoxynucleosides;
   a 5' wing segment consisting of five linked nucleosides;
   a 3' wing segment consisting of five linked nucleosides;
   wherein the gap segment is positioned between the 5' wing segment and the 3' wing segment, wherein each nucleoside of each wing segment comprises a 2'-O-methoxyethyl sugar, wherein each internucleoside linkage of said antisense oligonucleotide is a phosphorothioate linkage, and wherein each cytosine in said antisense oligonucleotide is a 5'-methylcytosine.

\* \* \* \* \*